(12) United States Patent
Brentnall et al.

(10) Patent No.: US 10,857,244 B2
(45) Date of Patent: *Dec. 8, 2020

(54) METHODS AND COMPOSITIONS FOR CANCER DIAGNOSIS

(71) Applicants: University of Washington through Its Center for Commercialization, Seattle, WA (US); The Board of Trustees of the Leland Stanford Junior University, Stanford, CA (US)

(72) Inventors: Teresa A. Brentnall, Seattle, WA (US); Juergen Karl Willmann, Stanford, CA (US); Sheng Pan, Seattle, WA (US)

(73) Assignees: University of Washington Through Its Center for Communication, Seattle, WA (US); The Board of Trustees of the Leland Stanford Junior University, Stanford, CA (US)

( * ) Notice: Subject to any disclaimer, the term of this patent is extended or adjusted under 35 U.S.C. 154(b) by 57 days.

This patent is subject to a terminal disclaimer.

(21) Appl. No.: 15/951,567

(22) Filed: Apr. 12, 2018

(65) Prior Publication Data

US 2018/0289844 A1 Oct. 11, 2018

Related U.S. Application Data

(62) Division of application No. 14/391,750, filed as application No. PCT/US2013/039070 on May 1, 2013.

(60) Provisional application No. 61/763,598, filed on Feb. 12, 2013, provisional application No. 61/641,210, filed on May 1, 2012.

(51) Int. Cl.
*A61K 49/22* (2006.01)
*G01N 33/574* (2006.01)

(52) U.S. Cl.
CPC .......... *A61K 49/221* (2013.01); *A61K 49/223* (2013.01); *G01N 33/57438* (2013.01)

(58) Field of Classification Search
CPC ............ A61K 2121/00; A61K 2123/00; A61K 49/00; A61K 49/221; A61K 49/223; A61K 49/10; A61K 49/12; A61K 49/14; A61K 49/16; A61K 49/18; A61K 49/22; A61K 51/00; A61K 51/04; A61K 51/06; A61K 51/08; A61K 51/10; G01N 33/57438
USPC .... 424/1.11, 1.29, 1.49, 1.65, 1.69, 9.1, 9.2, 424/9.3, 9.4, 9.5, 400, 450, 489
See application file for complete search history.

(56) References Cited

U.S. PATENT DOCUMENTS

| 9,381,219 | B2 | 7/2016 | Kaplan et al. |
| 2008/0305046 | A1 | 12/2008 | Hafezi-Moghadam |
| 2015/0283205 | A1 | 10/2015 | Phipps et al. |

OTHER PUBLICATIONS

Foygel et al, Gastroenterology, Oct. 2013 (published online on Jun. 18, 2013), vol. 145, Issue 4, pp. 885-894 (Year: 2013).*
Lee et al., "Thy-1, a novel marker for angiogenesis upregulated by inflammatory cytokines", Circ Res., May 4, 1998, pp. 845-851, vol. 82, Issue 8, American Heart Association, Inc., Dallas, TX.
Liang et al., "Diagnostic and prognostic biomarkers in pancreatic carcinoma", Int J Clin Exp Pathol., 2009, pp. 1-10, 2(1), e-Century Publishing Corporation, Madison, WI.
Linder, "Microbubbles in medical imaging: current applications and future directions", Nat Rev Drug Discov, 2004, pp. 527-532, 3, Macmillan Publishers Limited, Basingstoke, United Kingdom.
Linder, "Molecular imaging of myocardial and vascular disorders with ultrasound", JACC Cardiovasc Imaging, Feb. 2010, pp. 204-211, vol. 3, Issue 2, Elsevier, New York City, NY.
Longo et al., "Pancreatic cancer: from molecular signature to target therapy", Grit Rev Oncol Hematol., Dec. 2008, pp. 197-211, vol. 68, Issue 3, Elsevier, New York City, NY.
Lutz et al., "Early diagnosis of ovarian carcinoma: is a solution in sight?", Radiology, May 2011, pp. 329-345, vol. 259, Issue 2, Radiological Society of North America, Oak Brook, IL.
Madden et al., "Vascular gene expression in nonneoplastic and malignant brain", Am J Pathol., Aug. 2004, pp. 601-608, vol. 165, Issue 2, Elsevier, New York City, NY.
Malka et al., "Risk of pancreatic adenocarcinoma in chronic pancreatitis", Gut, 2002, pp. 849-852, vol. 51, Issue 6, BMJ Publishing Group Ltd., London, United Kingdom.
Maisonneuve et al., "Chronic pancreatitis and pancreatic cancer", Dig Dis., 2002, pp. 32-37, vol. 20, No. 1, Karger AG, Basell, Switzerland.
Marinho et al., "Angiogenesis in breast cancer is related to age but not to other prognostic parameters", Pathol Res Pract., Jan. 1, 1997, pp. 267-273, 193(4), Elsevier, New York City, NY.
Mazur et al., "Genetically engineered mouse models of pancreatic cancer: unravelling tumour biology and progressing translational oncology", Gut, Aug. 26, 2011, pp. 1488-1500, 61, BMJ Publishing Group Ltd., London, United Kingdom.
Naumov et al., "Role of angiogenesis in human tumor dormancy: animal models of the angiogenic switch", Cell Cycle, Aug. 17, 2006, pp. 1779-1787, vol. 5, Issue 16, Taylor & Francis Group, Abingdon, United Kingdom.
Neuschwander et al., "Repetitive acute pancreatic injury in the mouse induces procollagen alpha1 (I) expression colocalized to pancreatic stellate cells", Lab Invest., Feb. 1, 2000, pp. 143-150, 80, Macmillan Publishers Limited, Basingstoke, United Kingdom.
Pan et al., "Quantitative proteomics investigation of pancreatic intraepithelial neoplasia", Electrophoresis, Apr. 16, 2009, pp. 1132-1144, vol. 30, Issue 7, Wiley, Hoboken, NJ.
Pan et al., "Proteomics portrait of archival lesions of chronic pancreatitis", PLoS One, Nov. 23, 2011, pp. 1-12, vol. 6, Issue 11, e27574, PLoS One, San Francisco, CA.

(Continued)

*Primary Examiner* — D. L. Jones
(74) *Attorney, Agent, or Firm* — Pamela J. Sherwood; Bozicevic, Field & Francis LLP

(57) ABSTRACT

The present invention provides reagents and methods for detecting cancer and precancerous lesions in a patient.

5 Claims, 6 Drawing Sheets
(5 of 6 Drawing Sheet(s) Filed in Color)
Specification includes a Sequence Listing.

(56) References Cited

OTHER PUBLICATIONS

Philip et al., "Consensus report of the national cancer institute clinical trials planning meeting on pancreas cancer treatment ", J Clin Oncol., Nov. 20 2009, pp. 5660-5669, vol. 27,No. 33, American Society of Clinical Oncology, Alexandria, VA.
Pysz et al., "Assessment and monitoring tumor vascularity with contrast enhanced ultrasound maximum intensity persistence imaging", Invest Radial., Mar. 2011, pp. 187-195, 46(3), Wolters Kluwer Health, Inc., Philadelphia, PA.
Pysz et al., Antiangiogenic cancer therapy: monitoring with molecular US and a clinically translatable contrast agent (BR55), Radiology, Aug. 2010, pp. 519-527, vol. 256, Issue 2, Radiological Society of North America, Oak Brook, IL.
Pysz et al., "Molecular imaging: current status and emerging strategies", Clin Radiol., Jul. 2010, pp. 500-516, vol. 65, Issue 7, Elsevier, New York City, NY.
Pysz et al., "Quantitative assessment of tumor angiogenesis using real-time motion-compensated contrast-enhanced ultrasound imaging", Angiogenesis, Sep. 2012, pp. 433-442, vol. 15, Issue 3, Springer, Berlin, Germany.
Pysz et al., "Targeted Contrast-Enhanced Ultrasound: An Emerging Technology in Abdominal and Pelvic Imaging", Gastroenterology, Mar. 2011, pp. 785-790.e6, vol. 140, Issue 3, Elsevier, New York City, NY.
Reif et al., "The Akr Thymic Antigen and Its Distribution in Leukemias and Nervous Tissues", J Exp Med., Sep. 1, 1964, pp. 413-433, 120 (3), Rockefeller University Press, New York, NY.
Risau, "Angiogenesis is coming of age", Circulation Research, May 4, 1998, pp. 926-928, vol. 82, Issue 8, American Heart Association, Inc., Dallas, TX.
Sakorafas et al., "Molecular biology of pancreatic cancer: how useful is it in clinical practice?", JOP 2012, pp. 332-337, vol. 13, No. 4, iMedPub Ltd., London, United Kingdom.
Shaib et al., "The epidemiology of pancreatic cancer in the United States: changes below the surface", Aliment Pharmacal Ther., Jul. 2006, pp. 87-94, vol. 24, Issue 1, Wiley, Hoboken, NJ.
Siegel et al., "Cancer statistics, 2012. CA: A Cancer Journal for Clinicians", Jan./Feb. 2012, pp. 10-29, vol. 62, Issue 1, Wiley, Hoboken, NJ.
Singh et al., "Precursor lesions of pancreatic cancer: molecular pathology and clinical implications", Pancreatology May 2007, pp. 9-19, vol. 7, No. 1, Karger AG, Basel, Switzerland.
Singh et al., "Major molecular markers in pancreatic ductal adenocarcinoma and their roles in screening, diagnosis, prognosis, and treatment", Pancreas, Jul. 2011, pp. 644-652, vol. 40, Issue 5, Wolters Kluwer Health, Inc., Philadelphia, PA.
Sirsi et al., "Contrast ultrasound imaging for identification of early responder tumor models to anti-angiogenic therapy", Ultrasound in Medicine and Biology, Jun. 2012, pp. 1019-1029, vol. 38, Issue 6, Elsevier, New York City, NY.
St. Croix et al., "Genes expressed in human tumor endothelium", Science, Aug. 18, 2000, pp. 1197-1202, vol. 289, Issue 5482, American Association for the Advancement of Science, Washington, D.C.
Topazian et al., "Interobserver agreement for EUS findings in familial pancreatic-cancer kindreds", Gastrointest Endosc., Jul. 2007, pp. 62-67, vol. 66, Issue 1, Elsevier, New York City, NY.
Tse et al., "A glycophospholipid tail at the carboxyl terminus of the Thy-1 glycoprotein of neurons and thymocytes", Science, Nov. 29, 1985, pp. 1003-1008, vol. 230, Issue 4729, American Association for the Advancement of Science, Washington, D.C.
Verna et al., "Pancreatic cancer screening in a prospective cohort of high risk patients: a comprehensive strategy of imaging and genetics", Clinical Cancer Research, Oct. 2010, pp. 5028-5037, vol. 16, Issue 20, American Association for Cancer Research, Philadelphia, PA.
Wang et al., "Molecular Imaging of Inflammation in Inflammatory Bowel Disease with a Clinically-translatable DuaiSelectin-Targeted Ultrasound Contrast Agent: Comparison with FDG-PET-CT in a Mouse Model", Radiology, Jun. 2013, pp. 818-829, vol. 267, Issue 3, Radiological Society of North America, Oak Brook, IL.
Gessner et al., "Advances in molecular imaging with ultrasound", Mol Imaging, May 1, 2010, pp. 117-127, vol. 9, No. 3, Sage Publications Inc, Thousand Oaks, CA.
Weis et al., "Tumor angiogenesis: molecular pathways and therapeutic targets", Nat Med., Nov. 7, 2011, pp. 1359-1370, 17, Macmillan Publishers Limited, Basingstoke, United Kingdom.
Weller et al., "Ultrasonic imaging of tumor angiogenesis using contrast microbubbles targeted via the tumor-binding peptide arginine-arginine-leucine", Cancer Res 2005, Jan. 2005, pp. 533-539, vol. 65, Issue 2, American Association for Cancer Research, Philadelphia, PA.
Willaims, "Immunoglobulin-related domains for cell surface recognition", Nature, Apr. 18, 1985, pp. 579-580, 314, Macmillan Publishers Limited, Basingstoke, United Kingdom.
Willmann et al., "Monitoring of the biological response to murine hind limb ischemia with 64Cu-labeled vascular endothelial growth factor-121 positron emission tomography", Circulation, Feb. 19, 2008, pp. 915-922, vol. 117, Issue 7, American Heart Association, Inc., Dallas, TX.
Willmann et al., "Targeted microbubbles for imaging tumor angiogenesis: assessment of whole-body biodistribution with dynamic micro-PET in mice", Radiology, Oct. 2008, pp. 212-219, vol. 249, Issue 1, Radiological Society of North America, Oak Brook, IL.
Willmann et al., "Targeted contrast-enhanced ultrasound imaging of tumor angiogenesis with contrast microbubbles conjugated to integrin-binding knottin peptides", J Nucl Med., Mar. 2010, pp. 433-440, vol. 51 No. 3, Society of Nuclear Medicine and Molecular Imaging, Reston, VA.
Willmann et al., "Dual-targeted contrast agent for US assessment of tumor angiogenesis in vivo", Radiology, Sep. 2008, pp. 936-944, vol. 248, Issue 3, Radiological Society of North America, Oak Brook, IL.
Willmann et al., "US imaging of tumor angiogenesis with microbubbles targeted to vascular endothelial growth factor receptor type 2 in mice", Radiology, Feb. 2008, pp. 508-518, vol. 246, Issue 2, Radiological Society of North America, Oak Brook, IL.
Willmann et al., "Molecular imaging in drug development", Nat Rev Drug Discov., Jul. 1, 2008, pp. 591-607, 7, Macmillan Publishers Limited, Basingstoke, United Kingdom.
Zhao et al., "AUG-based biomarker ensemble with an application on gene scores predicting low bone mineral density", Bioinformatics, Nov. 1, 2011, pp. 3050-3055, vol. 27, Issue 21, Oxford University Press, Oxford, United Kingdom.
Kiessling et al., "Ultrasound Microbubbles for Molecular Diagnosis, Therapy, and Theranostics", J. Nucl. Med., Mar. 1, 2012, pp. 345-348, vol. 53, No. 3, Society of Nuclear Medicine and Molecular Imaging, Reston, VA.
Conrad et al., "Role of mitogen-activated protein kinases in Thy-1-induced T-lymphocyte activation", Cellular Signalling, Aug. 2009, pp. 1298-1307, vol. 21, Issue 8, Elsevier, New York City, NY.
Aguirre et al., "Activated Kras and Ink4a/Arf deficiency cooperate to produce metastatic pancreatic ductal adenocarcinoma", Genes Dev., 2003, pp. 3112-3126, 17, Cold Spring Harbor Laboratory Press, Cold Spring Harbor, NY.
Alajati et al., "Spheroid-based engineering of a human vasculature in mice", Nat. Methods, Apr. 6, 2008, pp. 439-445, 5, Macmillan Publishers Limited, Basingstoke, United Kingdom.
Altavilla et al., "Attenuated cerulein-induced pancreatitis in nuclear actorkappaB-deficient mice", Lab Invest., Dec. 1, 2003, pp. 1723-1732, 83, Macmillan Publishers Limited, Basingstoke, United Kingdom.
Anderson et al., "Ultrasound molecular imaging of tumor angiogenesis with an integrin targeted microbubble contrast agent", Investigative Radiology, Apr. 13, 2011, pp. 215-224, (46)4, Wolters Kluwer Health, Inc., Philadelphia, PA.
Arbiser et al.,"Oncogenic H-ras stimulates tumor angiogenesis by two distinct pathways", PNAS, Feb. 4, 1997, pp. 861-866, 94(3), National Academy of Sciences, Washington, D.C.

(56) References Cited

OTHER PUBLICATIONS

Ariyama et al., "Imaging of small pancreatic ductal adenocarcinoma", Pancreas, Apr. 1, 1998; pp. 396-401, 16(3), Wolters Kluwer Health, Inc., Philadelphia, PA.
Bachawal et al., Earlier Detection of Breast Cancer with Ultrasound Molecular Imaging in a Transgenic Mouse Model, Cancer Res., Mar. 15, 2013, pp. 1689-1698, vol. 73, Issue 6, American Association for Cancer Research, Philadelphia, PA.
Baine et al., "Transcriptional profiling of peripheral blood mononuclear cells in pancreatic cancer patients identifies novel genes with potential diagnostic utility", PLoS One, Feb. 10, 2011, pp. 1-11, 6(2): e17014, PLOS, San Francisco, CA.
Bettinger et al., "Ultrasound molecular imaging contrast agent binding to both E and P-selectin in different species", Invest Radiol., Sep. 2012, pp. 516-523, vol. 47, Issue 9, Wolters Kluwer Health, Inc., Philadelphia, PA.
Bhati et al., "Molecular characterization of human breast tumor vascular cells", Am J Pathol., May 2008, pp. 1381-1390, vol. 172, Issue 5, Elsevier, New York City, NY.
Bradley et al., "Roles and regulation of Thy-1, a context-dependent modulator of cell phenotype", Biofactors, May/Jun. 2009, pp. 258-265, vol. 35, Issue 3, Wiley, Hoboken, NJ.
Brentall, "Management strategies for patients with hereditary pancreatic cancer", Curr Treat Options Oncol., Oct. 2005, pp. 437-445, vol. 6, Issue 5, New York, NY.
Brentall, "Pancreatic cancer surveillance: learning as we go", Am J Gastroenterol, May 4, 2011, pp. 955-956, Macmillan Publishers Limited, Basingstoke, United Kingdom.
Buckanovich et al., "Tumor vascular proteins as biomarkers in ovarian cancer", J Clin Oncology, Mar. 1 2007, pp. 852-861, vol. 25, No. 7, American Society of Clinical Oncology, Alexandria, VA.
Cao, "Tumor Angiogenesis and molecular targets for therapy", Front Biosci., Jan. 1, 2009, 3962-3973, 14, Frontiers in Bioscience, Irvine, CA.
Chen et al., "Proteomics studies of pancreatic cancer", Proteomics Clin Appl., Dec. 4, 2007, pp. 1582-1591, vol. 1, Issue 12, No. 12, Wiley, Hoboken, NJ.
Chen et al., "Stromal galectin-1 expression is associated with long-term survival in resectable pancreatic ductal adenocarcinoma", Cancer Bioi Ther., Aug. 12, 2012, pp. 899-907, vol. 13, Issue 10, Taylor and Francis Group, Abingdon, Oxford.
Chen et al., "Pancreatic cancer proteome: the proteins that underlie invasion, metastasis, and immunologic escape", Gastroenterology, Oct. 2005, pp. 1187-1197, vol. 129, Issue 4, Elsevier, New York City, NY.
Chen et al., "Novel endothelial cell markers in hepatocellular carcinoma", Mod Pathol., May 21, 2004, pp. 1198-1210, 17, Macmillan Publishers Limited, Basingstoke, United Kingdom.
Claudon et al., "Guidelines and Good Clinical Practice Recommendations for Contrast Enhanced Ultrasound (CEUS) in the Liver—Update 2012", Ultrasound in Med. and Bio., Feb. 2013, pp. 187-210, vol. 39, Issue 2, Elsevier, New York City, NY.
Chari et al., "Probability of pancreatic cancer following diabetes: a population-based study", Gastroenterology, Aug. 2005, pp. 504-511, vol. 129, Issue 2, Elsevier, New York City, NY.
Deshpande et al., "Quantification and monitoring of inflammation in murine inflammatory bowel disease with targeted contrast-enhanced US", Radiology, Jan. 2012, pp. 172-180, vol. 262, Issue 1, Radiological Society of North America, Oak Brook, IL.
Deshpande et al., "Molecular ultrasound imaging: current status and future directions", Clin Radiol., Jul. 2010, pp. 567-581, vol. 65, Issue 7, Elsevier, New York City, NY.
Deshpande et al., "Molecular ultrasound assessment of tumor angiogenesis", Angiogenesis, Jun. 2010, p. 175-188, vol. 13, Issue 2, Springer, Berlin, Germany.
Deshpande et al., "Tumor angiogenic marker expression levels during tumor growth: longitudinal assessment with molecularly targeted microbubbles and US imaging", Radiology 2011, Mar. 2011, pp. 804-811, vol. 258, Issue 3, Radiological Society of North America, Oak Brook, IL.

Dickinson, "Multimodal imaging of mouse development: tools for the postgenomic era", Dev Dyn., Sep. 2006, pp. 2386-2400, vol. 235, Issue 9, Wiley, Hoboken, NJ.
Duffy et al., "Influence of hypoxia and neoangiogenesis on the growth of pancreatic cancer", Mol Cancer, Jan. 22, 2003, pp. 1-10, (2)12, BioMed Central Ltd., London, United Kingdom.
Ellegala et al., "Imaging tumor angiogenesis with contrast ultrasound and microbubbles targeted to alpha(v)beta3", Circulation, Jul. 22, 2003, pp. 336-341, vol. 108, Issue 3, American Heart Association, Inc., Dallas, TX.
Castillo et al., "Intraductal papillary mucinous neoplasms of the pancreas", Gastroenterology Sep. 2010, pp. 708-713.e2, vol. 139, Issue 3, Elsevier, New York City, NY.
Fidler et al, "The implications of angiogenesis for the biology and therapy of cancer metastasis", Cell, Oct. 21, 1994pp. 185-188, vol. 79, Issue 2, Elsevier, New York City, NY.
Fokman, "Tumor angiogenesis: therapeutic implications", N Engl J Med., Nov. 18, 1971, pp. 1182-11826, 285, Massachusetts Medical Society, Waltham, MA.
Gordon et al., "Regulation of Thy-1 gene expression in transgenic mice", Cell, Jul. 31, 1987, pp. 445-452, vol. 50, Issue 3, Elsevier, New York City, NY.
Habisch et al., "Interaction of Stellate Cells with Pancreatic Carcinoma Cells", Cancers, Sep. 9, 2010, pp. 1661-1682, 2(3), MDPI, Basel, Switzerland.
Hicklin et al., "Role of the vascular endothelial growth factor pathway in tumor growth and angiogenesis", J Clin Oncol., Feb. 2005, pp. 1011-1027, 23, No. 5, American Society of Clinical Oncology, Alexandria, VA.
Hingorani et al., "Preinvasive and invasive ductal pancreatic cancer and its early detection in the mouse", Cancer Cell, Dec. 2003, pp. 437-450, vol. 4, Issue 6, Elsevier, New York City, NY.
Hruban et al., "Pancreatic intraepithelial neoplasia: a new nomenclature and classification system for pancreatic duct lesions", Am J Surg Pathol., May 2001, pp. 579-586, vol. 25, Issue 5, Wolters Kluwer Health, Inc., Philadelphia, PA.
Hruban et al., "Progression model for pancreatic cancer", Clin Cancer Res., Aug. 2000, pp. 2969-2972, vol. 6, Issue 8, American Association for Cancer Research, Philadelphia, PA.
Hruban et al., "Pancreatic cancer in mice and man: the Penn Workshop 2004", Cancer Res., Jan. 2006, pp. 14-17, vol. 66, Issue 1, American Association for Cancer Research, Philadelphia, PA.
Hruban et al., "Genetic progression in the pancreatic ducts", Am J Pathol., Jun. 2000, pp. 1821-1825, 156(6), Elsevier, New York City, NY.
http://www.canaryfoundation.org/research/pancreatic-cancer/jurgen-k-willmann, 3 Pages, printed Mar. 31, 2015.
Kaneko et al., "Ultrasound for molecular imaging and therapy in cancer", Quant Imaging Med Surg., Jun. 2012, pp. 87-97, (2)2, AME Publishing Company, Hong Kong, China.
Kircher et al., "Molecular body imaging: MR imaging, CT, and US. part I. principles", Radiology, Jun. 2012, pp. 333-643, vol. 263, Issue 3, Radiological Society of North America, Oak Brook, IL.
Kircher et al., "Molecular body imaging: MR imaging, CT, and US. Part II. Applications", Radiology, Aug. 2012, pp. 349-368, vol. 264, Issue 2, Radiological Society of North America, Oak Brook, IL.
Kitada et al., "Clinicopathological significance of hypoxia-inducible factor-1 alpha expression in human pancreatic carcinoma", Histopathology, Dec. 2003, pp. 550-555, vol. 43, Issue 6, Wiley, Hoboken, NJ.
Kloppel, "Chronic pancreatitis, pseudotumors and other tumor-like lesions", Mod Pathol., Feb. 1, 2007, pp. 113-131, 20 Suppl1, Macmillan Publishers Limited, Basingstoke, United Kingdom.
Korc, "Pathways for aberrant angiogenesis in pancreatic cancer", Mol Cancer, Jan. 7, 2003, pp. 1-8, (2)8, BioMed Central Ltd., London, United Kingdom.
Laib et al., "Spheroid-based human endothelial cell microvessel formation in vivo", Nat Protoc., Jul. 30, 2009, pp. 1202-1215, 4, Macmillan Publishers Limited, Basingstoke, United Kingdom.

\* cited by examiner

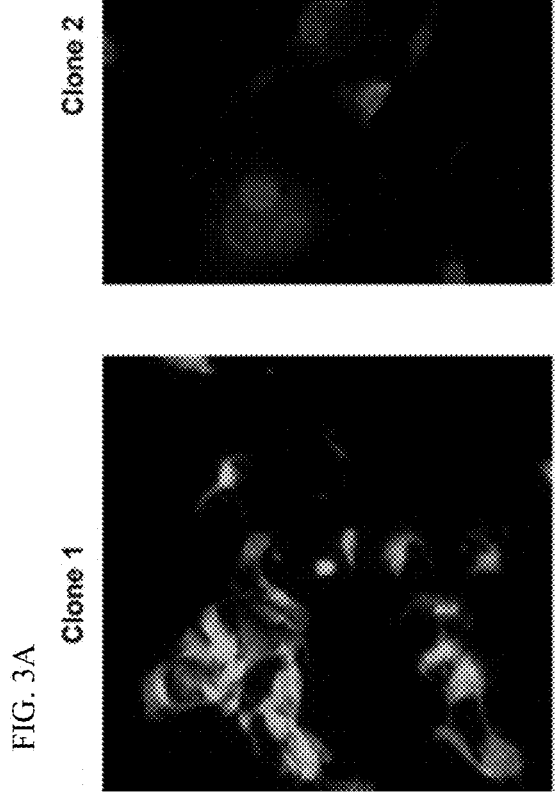
FIG. 3A
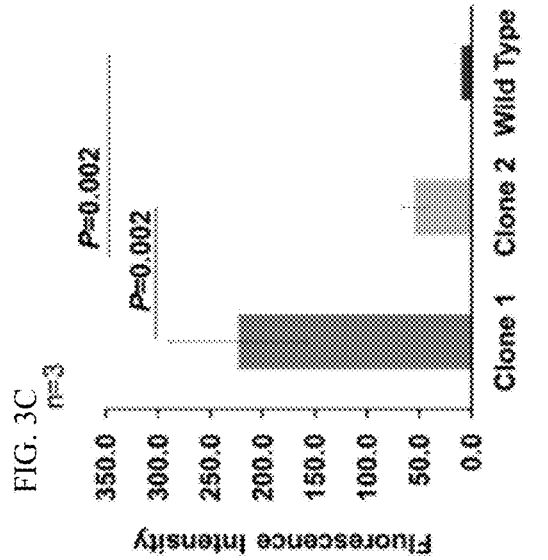
FIG. 3B
FIG. 3C
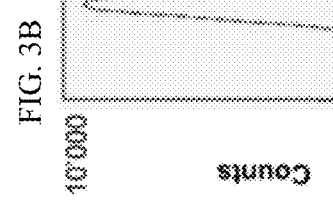

METHODS AND COMPOSITIONS FOR CANCER DIAGNOSIS

CROSS-REFERENCE

This application is a divisional application of U.S. patent application Ser. No. 14/391,750, filed Oct. 10, 2014, which is a U.S. National Phase of International Application No. PCT/US2013/039070, filed May 1, 2013, which claims priority to U.S. Provisional Patent Application No. 61/763,598, filed Feb. 12, 2013 and U.S. Provisional Patent Application No. 61/641,210, filed May 1, 2012, the disclosures of which are hereby incorporated by reference in their entireties.

STATEMENT REGARDING FEDERALLY SPONSORED RESEARCH

This invention was made with Government support under contracts CA139279 and CA107209 awarded by the National Institutes of Health. The Government has certain rights in the invention.

BACKGROUND

Pancreatic cancer is the fourth leading cause of cancer-related death in both women and men in the USA with an estimated 36,000 deaths in 2012 and 43,000 new diagnoses. Survival from pancreas cancer is stage dependent and currently the disease is most frequently detected at advanced tumor stages. Patients diagnosed with advanced pancreatic cancer have a median survival time of less than one year and are considered incurable at the time of diagnosis. Populations who are at elevated risk of pancreatic cancer include: adult-onset diabetics have a 1:300 lifetime risk, individuals who inherit a genetic predisposition to the disease (such as BRCA2 carriers) and individuals who have 2 or more family members with the disease.

For these moderate-to-high risk groups, methods for surveillance are currently limited. Therefore, novel, early detection/surveillance assays that are non-invasive, inexpensive and accurate are critically needed in order to reduce mortality from pancreatic cancer.

SUMMARY OF THE INVENTION

In one aspect, the present invention provides methods for detecting pancreatic cancer in a patient, or for determining a risk for pancreatic cancer development in a patient comprising:

(a) administering a detectable Thy-1 binding molecule to a patient at risk of having or developing pancreatic cancer, under conditions suitable to promote binding complex formation between the Thy-1 binding molecule and Thy-1 present in pancreatic tumor neovasculature or a precancerous lesion; and (b) detecting the presence or absence of the binding complexes; wherein the presence of an increased number of the binding complexes compared to control is indicative of the presence of pancreatic cancer in the patient or indicates a risk of pancreatic cancer development in the patient.

In another aspect, the invention provides methods for detecting pancreatic cancer in a patient, or for determining a risk for pancreatic cancer development in a patient comprising:

(a) administering a detectable binding molecule to a patient at risk of having or developing pancreatic cancer, wherein the binding molecule is selected from the group consisting of (a) MMRN1 binding molecules, (b) MRC2 binding molecules, (c) NRP1 binding molecules, and/or (d) VCAM1 binding molecules, under conditions suitable to promote binding complex formation between the binding molecule and a binding molecule target present in pancreatic tumor neovasculature or a precancerous lesion; and (b) detecting the presence or absence of the binding complexes; wherein the presence of an increased number of the binding complexes compared to control is indicative of the presence of pancreatic cancer in the patient or indicates a risk of pancreatic cancer development in the patient.

In a further aspect, the invention provides methods for determining efficacy of pancreatic cancer therapy in a patient, comprising:

(a) administering a detectable Thy-1 binding molecule to a patient undergoing or who has previously undergone pancreatic cancer therapy, under conditions suitable to promote binding of the Thy-1 binding molecule to Thy-1 in the pancreatic tumor neovasculature to form a binding complex; and (b) detecting the presence or absence of binding complexes; wherein the presence or absence of binding complexes is indicative of the efficacy of the anti-cancer therapy in the patient.

In a further aspect, the present invention provides methods for determining efficacy of pancreatic cancer therapy in a patient, comprising:

(a) administering a detectable binding molecule selected from the group consisting of (i) MMRN1 binding molecules, (ii) MRC2 binding molecules, (iii) NRP1 binding molecules, and (iv) VCAM1 binding molecules, to a patient undergoing or who has previously undergone pancreatic cancer therapy, under conditions suitable to promote binding complex formation between the binding molecule and its target present in pancreatic tumor neovasculature to form a binding complex; and (b) detecting the presence or absence of the binding complexes; wherein the presence or absence of binding complexes is indicative of the efficacy of the anti-cancer therapy in the patient.

In another aspect, the invention provides compositions, comprising:

(a) a first microbubble; and
(b) a plurality of Thy-1 binding molecules attached to a surface of the first microbubble.

In one embodiment the first microbubble may further comprise a plurality of other binding molecules attached to a surface of the first microbubble, wherein the other binding molecules are selected from the group consisting of (a) VEGFR2 binding molecules, (b) MMRN1 binding molecules, (c) MRC2 binding molecules, (d) NRP1 binding molecules, and/or (e) VCAM1 binding molecules. In another embodiment, the compositions may further comprise a second microbubble, wherein the second microbubble has attached to its surface a plurality of other binding molecules, wherein the other binding molecules are selected from the group consisting of (a) VEGFR2 binding molecules, (b) MMRN1 binding molecules, (c) MRC2 binding molecules, (d) NRP1 binding molecules, and/or (e) VCAM1 binding molecules.

In another aspect, the invention provides compositions, comprising a) a first microbubble; and
(b) a plurality of binding molecules attached to a surface of the first microbubble, wherein the binding molecules attached to the surface of the first microbubble are selected from the group consisting of (a) MMRN1 binding molecules, (b) MRC2 binding molecules, (c) NRP1 binding molecules, and/or (d) VCAM1 binding molecules.

In a further aspect, the invention provides methods for detecting cancer in a patient, or for determining a risk for cancer development in a patient comprising:

(a) administering the composition of any embodiment of the invention to a patient at risk of having or developing cancer, under conditions suitable to promote binding complex formation between the binding molecules and targets of the binding molecules present in neovasculature of the tumor or a precancerous lesion; and (b) detecting a presence or absence of the binding complexes using ultrasound molecular imaging; wherein the presence of an increased number of the binding complexes compared to control is indicative of the presence of cancer in the patient or indicates a risk of cancer development in the patient.

DESCRIPTION OF THE FIGURES

The invention is best understood from the following detailed description when read in conjunction with the accompanying drawings. The patent or application file contains at least one drawing executed in color. Copies of this patent or patent application publication with color drawing(s) will be provided by the Office upon request and payment of the necessary fee. It is emphasized that, according to common practice, the various features of the drawings are not to-scale. On the contrary, the dimensions of the various features are arbitrarily expanded or reduced for clarity. Included in the drawings are the following figures.

(FIG. 2C). Example of positive Thy1-staining on vessels associated with PDAC. Summary of IHC scores on Thy1 stained tissues from normal pancreas (normal), chronic pancreatitis (CP), and pancreatic cancer (PC).

FIG. 3A-3C. Evaluation of Thy1 expression on vascular endothelial cells. (FIG. 3A) Stably transfected cells and wild-type cells were assessed for human Thy1 expression by immunofluorescence staining. Clone 1 showed strong Thy1 staining, clone 2 showed low staining, and wild-type cells showed no Thy1 staining. (FIG. 3B) Human Thy1 expression levels on different cell types were quantitatively assessed by FACS analysis. Histogram overlay of signals from cells with different levels of Thy1 expression is shown. (FIG. 3C) Mean fluorescence intensity values are shown in bar graph. Error bars are ±standard deviations.

DETAILED DESCRIPTION OF THE INVENTION

Figure 1A:
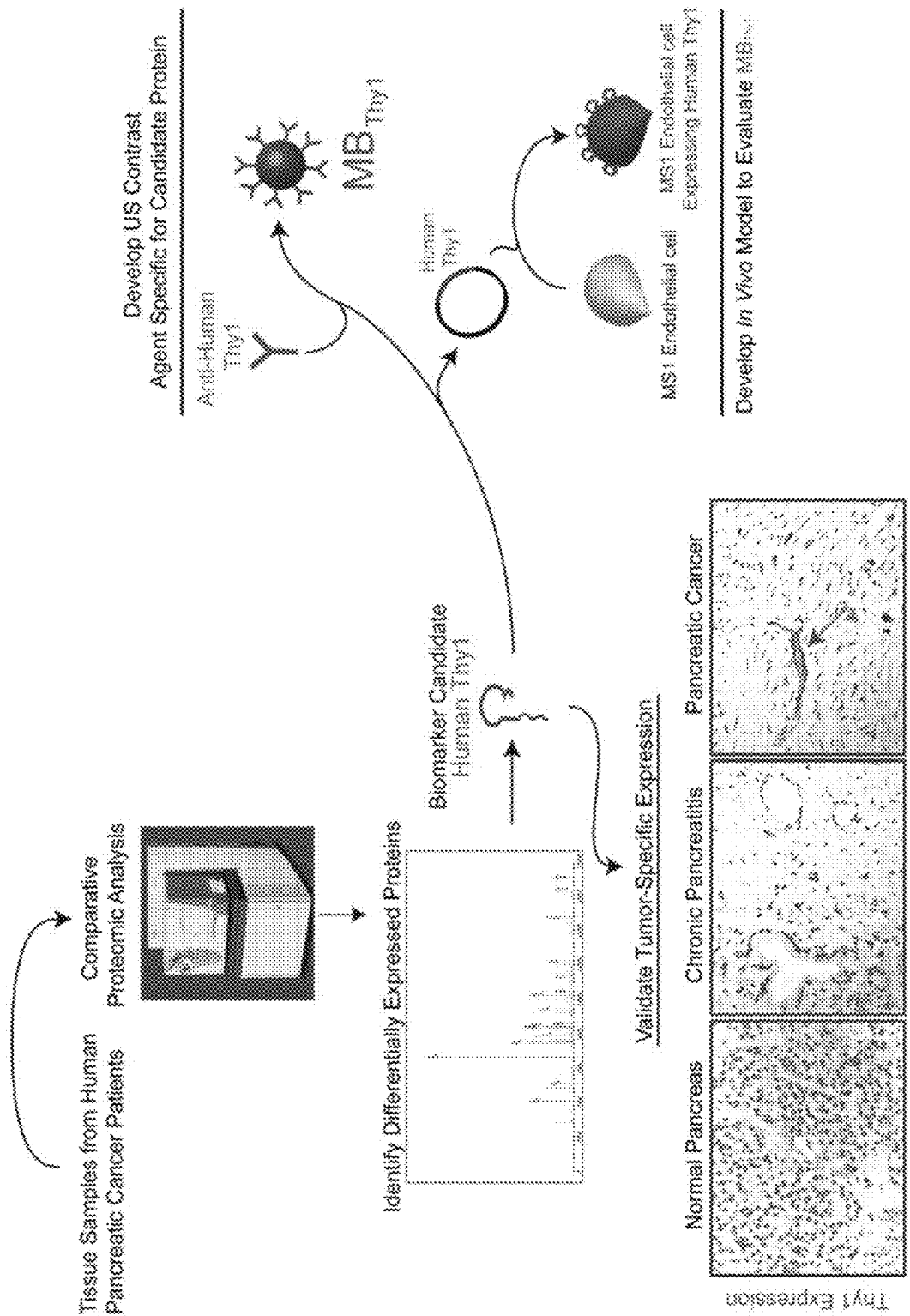
FIG. 1A-1B. Overview of study design, from identification of novel human PDAC-neovasculature-associated imaging biomarker Thy1, to target validation, creation of human Thy1-targeted ultrasound contrast agent, generation of a novel orthotopic PDAC xenograft model expressing human Thy1 on its neovasculature, and in vivo testing of imaging properties of Thy1-targeted ultrasound contrast agent.

All references cited are herein incorporated by reference in their entirety. Within this application, unless otherwise stated, the techniques utilized may be found in any of several well-known references such as: *Molecular Cloning: A Laboratory Manual* (Sambrook, et al., 1989, Cold Spring Harbor Laboratory Press), *Gene Expression Technology* (Methods in Enzymology, Vol. 185, edited by D. Goeddel, 1991. Academic Press, San Diego, Calif.), "Guide to Protein Purification" in *Methods in Enzymology* (M. P. Deutshcer, ed., (1990) Academic Press, Inc.); *PCR Protocols: A Guide to Methods and Applications* (Innis, et al. 1990. Academic Press, San Diego, Calif.), *Culture of Animal Cells: A Manual of Basic Technique*, $2^{nd}$ Ed. (R. I. Freshney. 1987. Liss, Inc. New York, N.Y.), *Gene Transfer and Expression Protocols*, pp. 109-128, ed. E. J. Murray, The Humana Press Inc., Clifton, N.J.), and the Ambion 1998 Catalog (Ambion, Austin, Tex.).

As used herein, the singular forms "a", "an" and "the" include plural referents unless the context clearly dictates otherwise. "And" as used herein is interchangeably used with "or" unless expressly stated otherwise.

As used herein, the term "about" means +/−5% of the stated value.

As used herein, the amino acid residues are abbreviated as follows: alanine (Ala; A), asparagine (Asn; N), aspartic acid (Asp; D), arginine (Arg; R), cysteine (Cys; C), glutamic acid (Glu; E), glutamine (Gln; Q), glycine (Gly; G), histidine (His; H), isoleucine (Ile; I), leucine (Leu; L), lysine (Lys; K), methionine (Met; M), phenylalanine (Phe; F), proline (Pro; P), serine (Ser; S), threonine (Thr; T), tryptophan (Trp; W), tyrosine (Tyr; Y), and valine (Val; V).

All embodiments of any aspect of the invention can be used in combination, unless the context clearly dictates otherwise.

Unless the context clearly requires otherwise, throughout the description and the claims, the words 'comprise', 'comprising', and the like are to be construed in an inclusive sense as opposed to an exclusive or exhaustive sense; that is to say, in the sense of "including, but not limited to". Words using the singular or plural number also include the plural and singular number, respectively. Additionally, the words "herein," "above," and "below" and words of similar import, when used in this application, shall refer to this application as a whole and not to any particular portions of the application.

The description of embodiments of the disclosure is not intended to be exhaustive or to limit the disclosure to the precise form disclosed. While the specific embodiments of, and examples for, the disclosure are described herein for illustrative purposes, various equivalent modifications are possible within the scope of the disclosure, as those skilled in the relevant art will recognize.

In a first aspect, the present invention provides novel compositions, comprising
(a) a first microbubble; and
(b) a plurality of Thy-1 binding molecules attached to a surface of the first microbubble.

The inventors have discovered that Thy-1 is present in newly created micro-blood vessels in cancer, but is not present in normal blood vessels. Thy-1 specific binding molecules are shown herein for the first time to stain cancer-related blood vessels in pre-cancer as well as cancer. Thus, the compositions of the invention find wide use as, for example, imaging agents to enhance early stage cancer detection, as well as pre-cancerous states in individuals at risk for developing cancer, including but not limited to pancreatic cancer.

Human Thy-1 or CD90 (Cluster of Differentiation 90) is a 25-37 kDa N-glycosylated, glycophosphatidylinositol (GPI) anchored conserved cell surface protein. Its amino acid sequence is provided in SEQ ID NO:1.

As used herein, "microbubbles" refer to micron-sized contrast agents composed of a shell and a gas core, as is well known to those of skill in the art. Microbubbles are commercially available from a number of sources. The shell may be formed from any suitable material, including but not limited to albumin, polysaccharides (such as galactose), lipids (such as phospholipids), polymers and combinations thereof. Any suitable gas core can be used in the microbubbles of the invention, including but not limited to air, octafluoropropane, perfluorocarbon, sulfur hexafluoride or nitrogen. The gas core determines the echogenecity of the microbubble. When gas bubbles are caught in an ultrasound frequency field, they compress, oscillate, and reflect a characteristic echo, this generates the strong and unique sonogram in contrast-enhanced ultrasound. Gas cores can be composed of air, or heavy gases like octafluoropropane, perfluorocarbon, sulfur hexafluoride or nitrogen. Heavy gases are less water-soluble so they are less likely to leak out from the microbubble to impair echogenecity. The average diameter of the microbubble can be between 1 µm and 25 µm. In general, the microbubbles have a diameter of about 1 µm and about 10 µm on average, and more preferably between about 1 µm and 5 µm, 1 µm and 4 µm, 1 µm and 3 µm, 1 µm and about 2 µm, 2 µm and 5 µm, 2 µm and 4 µm, 2 µm and 3 µm, 3 µm and 5 µm, 3 µm and 4 µm, or about as 1 µm, 2 µm, 2.5 µm, 3 µm, 3.5 µm or 4 µm on average. OPTISON®. (made by GE Healthcare) was the first microbubble approved by Food and Drug Administration (FDA), and has an albumin shell and octafluoropropane ($C_3F_8$) gas core. The second FDA-approved microbubble, LEVOVIST®, (made by Schering AG), has a palmitic acid/galactose shell and an air core. Other examples of microbubble include, but are not limited to ALBUNEX® (made by Molecular Biosystems), SONOVUE® (made by Bracco Diagnostics, Inc.), SONOZOID® (made by Schering AG), SONOVIST® (made by Schering AG), and DEFINITY® (made by DuPont Pharmaceuticals). ALBUNEX® has an albumin shell and an air core. SONOVUE® and contains a sulfur hexafluoride ($SF_6$) gas core that is stabilized in aqueous dispersion of a monolayer of phospholipids. SONOZOID® is another microbubble preparation containing a perfluorocarbon gas core and a lipid shell. DEFINITY® is another FDA-approved microbubble that contains a lipid shell and an octafluoropropane ($C_3F_8$) gas core. In one exemplary embodiment, microbubbles of the present invention comprise a lipid shell and perfluorocarbon gas core of between about 1 µm and about 5 µm, 1 µm and about 4 µm diameter, 1 µm and about 3 µm, or 1 µm and about 2 µm, on average.

The microbubbles of the invention can be used, for example, as a contrast agent for ultrasound imaging. Microbubbles have a high degree of echogenicity (i.e.: the ability of an object to reflect ultrasound waves). The echogenicity difference between the gas in the microbubbles and the soft tissue surroundings of the body is large. Thus, ultrasonic imaging using microbubble contrast agents enhances the ultrasound backscatter, or reflection of the ultrasound waves, to produce a unique sonogram with increased contrast due to the high echogenicity difference.

The microbubbles can be functionalized in any suitable manner for binding of the Thy-1 binding molecules (or other binding molecules, as described herein). Such techniques are well known to those of skill in the art, such as those for functionalizing the surface of a microbubble to permit binding of a protein. In one embodiment, the microbubble surface if functionalized to permit direct attachment of the binding agent to the microbubble surface. In another embodiment, the microbubble surface is functionalized to permit indirect attachment of the binding molecule to the microbubble surface. In one non-limiting embodiment of indirect binding, the microbubble surface can be coated with streptavidin, to which biotinylated binding molecules can be bound. Any other suitable binding pair can be similarly used, as will be apparent to those of skill in the art.

Following administration to the patient (such as by intravenous injection), the targeted microbubbles accumulate at tissue sites that over-express Thy-1 (or other markers discussed herein), causing a local increase in the ultrasound imaging signal. Due to their small size, the microbubbles stay predominantly within the vascular compartment after intravenous injection. Thus, the microbubbles can be used, for example, to exclusively detect vascular endothelial cell associated molecular markers that are present in early stage cancers or precancerous lesions.

A "Thy-1 binding molecule" is any molecular entity capable of selectively binding to human Thy-1. Exemplary specific binding agents include, but are not limited to, Thy-1 itself (SEQ ID NO:1), anti-Thy-1 antibodies or fragments thereof, aptamers selective for Thy-1, the I-domain (SEQ ID NO:3) of αX (CD11c) integrin domain, or proteins comprising this I domain, including but not limited to αX (SEQ ID NO:2, noting that AA 1-19 constitutes the signal peptide, and thus can be deleted), and αX-β2 integrin; the I-domain (SEQ ID NO:5) of αM integrin domain, or proteins comprising this I domain, including but not limited to αM (SEQ ID NO:4) and αM-β2 integrin (see Choi et al., Biochemical and Biophysical Research Communications; July 2005; 331 (2):557-61. DOI:10.1016/j.bbrc.2005.04.006); integrin αv-β3 (CD51/CD61), Mac-1 (CD11b/CD18), β3-integrin (SEQ ID NO:6) or the I-domain (SEQ ID NO:7) of β3-integrin (see Leyton et al., Current Biology, Volume 11, Issue 13, 1028-1038, 10 Jul. 2001), adhesion G-protein coupled receptor CD97 (SEQ ID NO:8) (see Wandel et al, The Journal of Immunology Feb. 1, 2012 vol. 188 no. 3 1442-1450), and a protein selected from the group consisting of SEQ ID NOS:9-20 as listed in Table 1.

TABLE 1

Other Interacting proteins for THY1

ITGAV Integrin alpha-V (SEQ ID NO: 9)
FYN Tyrosine protein kinase-Fyn (SEQ ID NO: 10)
LCK Tyrosine protein kinase -Lck (SEQ ID NO: 11)
ITGAM Integrin alpha-M (SEQ ID NO: 12)
ITGB3 Integrin Beta-3 (SEQ ID NO: 13)
YWHAB 14-3-3 protein beta/alpha (SEQ ID NO: 14)
APP amyloid beta A4 protein (SEQ ID NO: 15)
ITGB2 Integrin beta-2 (SEQ ID NO: 16)
STAT6 Signal transducer and activator of transcription 6 (SEQ ID NO: 17)
ARHGAP35 Rho GTPase activating protein 35 (SEQ ID NO: 18)
ARHGAP5 Rho GTPase activating protein 5 (SEQ ID NO: 19)
BOAT Brother of ataxin-1 (SEQ ID NO: 20)

In another embodiment, the first microbubble further comprises a plurality of other binding molecules attached to a surface of the first microbubble, wherein the other binding molecules are selected from the group consisting of (a) VEGFR2 binding molecules, (b) multimerin-1 (MMRN1) binding molecules, (c) mannose receptor type 2 (MRC2) binding molecules, (d) neuropilin 1 (NRP1) binding molecules, and/or (e) vascular cell adhesion molecule 1 (VCAM1) binding molecules.

As disclosed in the examples that follow, the inventors have identified MMRN1 (SEQ ID NO:21), MRC2 (SEQ ID NO:55), NRP1 (SEQ ID NO:57), and VCAM1 (SEQ ID NO:90) as additional vascular endothelial cell markers that can be used in identifying tumor neovasculature, and which thus can be used in combination with Thy-1 (as can VEGFR2) as markers for early stage cancer and precancerous lesion detection. In one embodiment, the first microbubble, such as a population of first microbubbles, would each comprise both Thy-1 binding molecules and "other" binding molecules for one or more of VEGFR2, MMRN1, MRC2, NRP1, and VCAM1. In a preferred embodiment, the first population of microbubbles contains other binding molecules for 1, 2, 3, or all 4 of MMRN1, MRC2, NRP1, and VCAM1.

In another embodiment, the composition further comprises a second microbubble, wherein the second microbubble has attached to its surface a plurality of other binding molecules, wherein the other binding molecules are selected from the group consisting of (a) VEGFR2 binding molecules, (b) MMRN1 binding molecules, (c) MRC2 binding molecules, (d) NRP1 binding molecules, and/or (e) VCAM1 binding molecules. In this embodiment, composition would comprise different subsets of microbubbles: a first microbubble (such as a population of first microbubbles) that comprises Thy-1 binding molecules, and at least a second microbubble (such as a population of second microbubbles) that includes binding molecules for one or more of VEGFR2, MMRN1, MRC2, NRP1, and VCAM1. In one embodiment, the second population of microbubbles may each comprise VEGFR2, MMRN1, MRC2, NRP1, and VCAM1. In another embodiment, the second population of microbubbles may each comprise other binding molecules for only one of VEGFR2, MMRN1, MRC2, NRP1, and VCAM1. In another embodiment, the second population of microbubbles may comprise a second population of microbubbles that each have VEGFR2 binding molecules, a third population of microbubbles that each have MMRN binding molecules, a fourth population of binding molecules that each have MRC2 binding molecules, a fifth population of microbubbles that each have NRP binding molecules, and a sixth population of microbubbles that each have VCAM1 binding molecules. In a further embodiment, the second population of microbubbles may comprise a second population that each have binding molecules for two of MMRN1, MRC2, NRP1, and VCAM1, and a third population of microbubbles comprising binding molecules for the other two of MMRN1, MRC2, NRP1, and VCAM1. Many variations are possible that use all or a subset of the recited binding molecules, as will be understood by those of skill in the art based on the teachings herein. In a preferred embodiment, the other binding molecules are binding molecules for one or more of MMRN1, MRC2, NRP1, and VCAM1.

In embodiments where at least a first and second population of microbubbles are present in the composition, the different populations of microbubbles (i.e.: first microbubble, second microbubble, etc.) can be prepared so as to be distinguishable from each other, though this is not a requirement for use of multiple populations of microbubbles in the methods of the invention. Any suitable means to distinguish the microbubbles can be used, including but not limited to, differentially labeling each population with a separate detectable label (fluorescent, radioactive, etc.) and using different sized microbubbles for each different microbubble population.

Multimerin-1 (MMR) is a soluble human protein found in platelets and in the endothelium of blood vessels. It is composed of linked subunits to form large, variably sized homomultimer. MMR1 has a number of identified ligands. A "MMR1 binding molecule" is any molecular entity capable of selectively binding to human MMR1. Exemplary specific binding molecules include, but are not limited to, MMR1 itself (SEQ ID NO:21), anti-MMR1 antibodies, and a protein selected from the group consisting of SEQ ID NOS: 22 to 54 (see Table 2 below).

TABLE 2

Interacting proteins for MMR1

F5 Coagulation factor V (SEQ ID NO; 22)
APC Adenomatous polyposis coli protein (SEQ ID NO; 23)
ALB albumin (SEQ ID NO; 24)
APP amyloid beta (A4) precursor protein (SEQ ID NO; 25)
EGF epidermal growth factor (SEQ ID NO; 26)
F8 Coagulation factor 8 (SEQ ID NO; 27)
FN1 fibronectin 1 (SEQ ID NO; 28)
KNG1 Kininogen 1 (SEQ ID NO; 29)
PF4 Platelet factor 4 (SEQ ID NO; 30)
PLG plasminogen (SEQ ID NO; 31)
PPBP pro-platelet basic protein (SEQ ID NO; 32)
SERPINE1 serpin peptidase inhibitor, clade E (SEQ ID NO; 33)
SPARC secreted protein acidic cysteine-rich (SEQ ID NO; 34)
SRGN serglycin (SEQ ID NO; 35)
TGFB1 transforming growth factor, beta 1 (SEQ ID NO; 36)
TGFB3 transforming growth factor, beta 3 (SEQ ID NO; 37)
A2M alpha-2-macroglobulin (SEQ ID NO; 38)
ACTN1 actinin, alpha 1 (SEQ ID NO; 39)
ACTN2 actinin, alpha 2 (SEQ ID NO; 40)
ACTN4 actinin, alpha 4 (SEQ ID NO; 41)
ALDOA aldolase A (SEQ ID NO; 42)
CFD complement factor D (SEQ ID NO; 43)
CLU clusterin (SEQ ID NO; 44)
F13A1 coagulation factor 13, A1 polypeptide (SEQ ID NO; 45)
FIGF c-fos induced growth factor (SEQ ID NO; 46)
GAS6 growth arrest-specific 6 (SEQ ID NO; 47)
SERPINA1 serpin peptidase inhibitor, clade A (SEQ ID NO; 48)
SERPINF2 serpin peptidase inhibitor, clade F (SEQ ID NO; 49)
SERPING1 serpin peptidase inhibitor, clade G (SEQ ID NO; 50)
TGFB2 transforming growth factor, beta 2 (SEQ ID NO; 51)
TIMP1 TIMP metallopeptidase inhibitor 1 (SEQ ID NO; 52)
VEGFC vascular endothelial growth factor C (SEQ ID NO; 53)
CDKN2A cyclin-dependent kinase inhibitor 2A (SEQ ID NO; 54)

A "MRC2 binding molecule" is any molecular entity capable of selectively binding to human MRC2. Exemplary specific binding molecules include, but are not limited to, MRC2 itself (SEQ ID NO:55), anti-MRC2 antibodies, and the NDEL1 protein comprising the amino acid SEQ ID NO: 56, an identified ligand for MRC2.

A "NRP1 binding molecule" is any molecular entity capable of selectively binding to human NRP1. Exemplary specific binding molecules include, but are not limited to, NRP1 itself (SEQ ID NO:57), anti-NRP1 antibodies, and a protein selected from the group consisting of SEQ ID NOS:58-89, identified ligands for NRP11 (see table below).

TABLE 3

Interacting proteins for NRP1

VEGFA Vascular endothelial growth factor A (SEQ ID NO: 58)
KDR Vascular endothelial growth factor receptor 2 (SEQ ID NO: 59)
SEMA3A Semaphorin-3A (SEQ ID NO: 60)
SEMA3F Semaphorin-3F (SEQ ID NO: 61)
VEGFB Vascular endothelial growth factor B (SEQ ID NO: 62)
FGF4 fibroblast growth factor 4 (SEQ ID NO: 63)
FLT1 vascular endothelial growth factor receptor 1 (SEQ ID NO: 64)
NRP2 Neuropilin-2 (SEQ ID NO: 65)
PGF placenta growth factor (SEQ ID NO: 66)
SRRM1 serine/arginine repetitive matrix protein 1 (SEQ ID NO: 67)
GIPC1 PDZ domain-containing protein GIPC1 (SEQ ID NO: 68)
SEMA3C semaphorin-3C (SEQ ID NO: 69)
FGF1 fibroblast growth factor 1 (SEQ ID NO: 70)
FGF2 fibroblast growth factor 2 (SEQ ID NO: 71)
FGF7 fibroblast growth factor 7 (SEQ ID NO: 72)
FGFR1 fibroblast growth factor receptor 1 (SEQ ID NO: 73)
PTK2 Focal adhesion kinase 1 (SEQ ID NO: 74)
SEMA3B semaphoring-3B (SEQ ID NO: 75)
FGFBP1 fibroblast growth factor-binding protein 1 (SEQ ID NO: 76)
SQSTM1 sequestosome-1 (SEQ ID NO: 77)
IGHG1 immunoglobulin heavy constant gamma 1 (SEQ ID NO: 78)
IGKC immunoglobulin kappa constant (SEQ ID NO: 79)
L1CAM L1 cell adhesion molecule (SEQ ID NO: 80)
SEMA3D semaphorin 3D (SEQ ID NO: 81)
SEMA3G semaphorin 3G (SEQ ID NO: 82)
PLXNA1 plexin A1 (SEQ ID NO: 83)
PLXNA2 plexin A2 (SEQ ID NO: 84)
SEMA3E semaphoring 3E (SEQ ID NO: 85)
ITGA5 integrin, alpha 5 (SEQ ID NO: 86)
ATN1 atrophin 1 (SEQ ID NO: 87)
GFI1B growth factor independent 1B transcription repressor (SEQ ID NO: 88)
(SEQ ID NO: 89)

A "VCAM1 binding molecule" is any molecular entity capable of selectively binding to human VCAM 1. Exemplary specific binding molecules include, but are not limited to, VCAM1 itself (SEQ ID NO:90), anti-VCAM1 antibodies, and a protein selected from the group consisting of SEQ ID NOS: 91 to 130, identified ligands for VCAM1 (see table below).

TABLE 4

40 Interacting proteins for VCAM1

ITGB7 integrin beta-7 (SEQ ID NO: 91)
IL13 interleukin-13 (SEQ ID NO: 92)
EZR ezrin (SEQ ID NO: 93)
MSN moesin (SEQ ID NO: 94)
CCL17 c-c motif chemokine 17 (SEQ ID NO: 95)
CTSG cathepsin G (SEQ ID NO: 96)
ELANE neutrophil; elastase (SEQ ID NO: 97)
ITGAD integrin alpha-D (SEQ ID NO: 98)
ITGB1 integrin beta-1 (SEQ ID NO: 99)
CCL22 C-C motif chemokine 22 (SEQ ID NO: 100)
IRF1 interferon regulatory factor 1 (SEQ ID NO: 101)
NFKB1 nuclear factor NF-kappa-B p105 subunit (SEQ ID NO: 102)
LGALS3 Galectin-3 (SEQ ID NO: 103)

TABLE 4-continued

40 Interacting proteins for VCAM1

RELB transcription factor RelB (SEQ ID NO: 104)
RDX radixin (SEQ ID NO: 105)
RELA transcription factor p65 (SEQ ID NO: 106)
CYBA cytochrome b-245, alpha polypeptide (SEQ ID NO: 107)
CYBB cytochrome b-245, beta polypeptide (SEQ ID NO: 108)
ITGA4 integrin, alpha 4 (SEQ ID NO: 109)
ITGA9 integrin, alpha 9 (SEQ ID NO: 110)
NCF2 neutrophil cytosolic factor 2 (SEQ ID NO: 111)
NOX1 NADPH oxidase 1 (SEQ ID NO: 112)
PRKCA protein kinase C, alpha (SEQ ID NO: 113)
PRKCH protein kinase C, eta (SEQ ID NO: 114)
SRC v-src sarcoma (SEQ ID NO: 115)
NOX3 NADPH oxidase 3 (SEQ ID NO: 116)
PRKCD protein kinase C, delta (SEQ ID NO: 117)
PRKCE protein kinase C, epsilon (SEQ ID NO: 118)
PRKCG protein kinase c, gamma (SEQ ID NO: 119)
PRKCQ protein kinase C, theta (SEQ ID NO: 120)
PIK3CA phosphatidylinositol-4,5-bisphosphate 3-kinase, catalytic subunit alpha (SEQ ID NO: 121)
PIK3CB phosphatidylinositol-4,5-bisphosphate 3-kinase, catalytic subunit beta (SEQ ID NO: 122)
PIK3CD phosphatidylinositol-4,5-bisphosphate 3-kinase, catalytic subunit delta (SEQ ID NO: 123)
PIK3CG phosphatidylinositol-4,5-bisphosphate 3-kinase, catalytic subunit gamma (SEQ ID NO: 124)
PIK3R1 phosphoinositide-3-kinase, regulatory subunit 1 (alpha) (SEQ ID NO: 125)
PIK3R2 phosphoinositide-3-kinase, regulatory subunit 2 (beta) (SEQ ID NO: 126)
PIK3R3 phosphoinositide-3-kinase, regulatory subunit 3 (gamma) (SEQ ID NO: 127)
PIK3R5 phosphoinositide-3-kinase, regulatory subunit 5 (SEQ ID NO: 128)
GRCh37 (SEQ ID NO: 129)
GRCh37 (SEQ ID NO: 130)

A "VEGFR2 binding molecule" is any molecular entity capable of selectively binding to human VEGFR2. Exemplary specific binding molecules include, but are not limited to, VEGFR2 itself (SEQ ID NO:131), and anti-VEGFR2 antibodies.

In a second aspect, the present invention provides compositions, comprising
a) a first microbubble; and
(b) a plurality of binding molecules attached to a surface of the first microbubble, wherein the binding molecules attached to the surface of the first microbubble are selected from the group consisting of (a) MMRN1 binding molecules, (b) MRC2 binding molecules, (c) NRP1 binding molecules, and/or (d) VCAM1 binding molecules.

The inventors have discovered that each of MMRN1, MRC2, NRP1, and VCAM1 are present in newly created micro-blood vessels in cancer, but is not present in normal blood vessels. Thy-1 specific binding molecules are shown herein for the first time to stain cancer-related blood vessels in pre-cancer as well as cancer. Thus, the compositions of the invention find wide use as, for example, imaging agents to enhance early stage cancer detection, as well as pre-cancerous states in individuals at risk for developing cancer, including but not limited to pancreatic cancer All definitions and embodiments of the first aspect of the invention apply equally to this second embodiment.

In all of these embodiments, antibodies that can be used as binding molecules mean an immunoglobulin molecule immunologically reactive with the recited target, and includes polyclonal and monoclonal antibodies. Various isotypes of antibodies exist, for example IgG1, IgG2, IgG3, IgG4, and other Ig, e.g., IgM, IgA, IgE isotypes. The term also includes genetically engineered forms such as chimeric antibodies (e.g., humanized murine antibodies) and heteroconjugate antibodies (e.g., bispecific antibodies), and fully humanized antibodies. As used throughout the application, the term "antibody" includes fragments with antigen-binding capability (e.g., Fab', F(ab')$_2$, Fab, Fv and rIgG, as are well known in the art. The term also refers to recombinant single chain Fv fragments (scFv). The term antibody also includes bivalent or bispecific molecules, diabodies, triabodies, and tetrabodies, as are known in the art. Antibodies for many if not all of the proteins disclosed herein are commercially available.

In all of these embodiments of the microbubbles of the invention, the binding molecules on the surface of the microbubbles can be at any density that is effective for targeting of the microbubble to target-containing neovasculature in a target tumor or precancerous lesion. In one embodiment, the average number of binding molecules per square micrometer of the microbubble surface in a microbubble population is at least 1,000/cm$^2$; in various further embodiments, it is at least 2,000/cm$^2$, 3,000/cm$^2$, 4,000/cm$^2$, 5,000/cm$^2$, 6,000/cm$^2$, 7,000/cm$^2$, 7,500/cm$^2$, or 7,600/cm$^2$.

The compositions may comprise any number of microbubbles in the composition that can be detected once targeted to the target-containing neovasculature in a target tumor or precancerous lesion. In one embodiment that can be combined with any other embodiment herein, the compositions comprise at least 10$^6$ microbubbles (i.e.: combined total of all microbubbles, whether all first microbubbles, or a combination of first and second microbubbles. In various further embodiments, the compositions comprises at least 2×10$^6$, 3×10$^6$, 5×10$^6$, 7.5×10$^6$, 10$^7$, 2×10$^7$, 3×10$^7$, 5×10$^7$, 7.5×10$^7$, 10$^8$, 2×10$^8$, 3×10$^8$, 5×10$^8$, 7.5×10$^8$, or at least 10$^9$ microbubbles.

Since the microbubbles of the invention target tumor or precancerous lesion neovasculature upon administration, they can also be used as a drug delivery device. Thus, in another embodiment, the composition of any embodiment or combination of embodiments of the present invention further comprises one or more anti-cancer therapeutics on or in the first microbubble and/or the second microbubble. In this embodiment, any suitable anti-cancer therapeutic can be loaded onto or into the microbubbles, including but not limited to alkylating agents such as busulfan, cis-platin, mitomycin C, and carboplatin; antimitotic agents such as colchicine, vinblastine, paclitaxel, and docetaxel; topo I inhibitors such as camptothecin and topotecan; topo II inhibitors such as doxorubicin and etoposide; RNA/DNA antimetabolites such as 5-azacytidine, 5-fluorouracil and methotrexate; DNA antimetabolites such as 5-fluoro-2'-deoxy-uridine, ara-C, hydroxyurea and thioguanine; antibodies such as Herceptin®. and Rituxan®, melphalan, chlorambucil, cyclophosphamide, ifosfamide, vincristine, mitoguazone, epirubicin, aclarubicin, bleomycin, mitoxantrone, elliptinium, fludarabine, octreotide, retinoic acid, tamoxifen and alanosine.

Techniques for loading compounds onto or into microbubbles are well known in the art; any such suitable technique can be used to produce the microbubbles of this embodiment of the invention.

In a third aspect, the present invention provides methods for detecting cancer in a patient, or for determining a risk for cancer development in a patient comprising:

(a) administering the composition of any embodiment or combination of embodiments of the first or second aspect of the invention to a patient at risk of having or developing cancer, under conditions suitable to promote binding complex formation between the binding molecules and targets of the binding molecules present in neovasculature of the tumor or a precancerous lesion; and (b) detecting a presence or absence of the binding complexes using ultrasound molecular imaging; wherein the presence of an increased number of the binding complexes compared to control is indicative of the presence of cancer in the patient or indicates a risk of cancer development in the patient.

As discussed above, the inventors have found that the microbubbles of the present invention can be used as a general tool for detection of tumor neovasculature, such as in early stage tumors and precancerous lesions. As used herein, "neovasculature" means the vasculature of tumors.

The methods according to this aspect of the invention can be used with any patient at risk of having or developing cancer. The patient may be any mammal, such as a human. As used herein the term "cancer" is intended to mean any cellular malignancy whose unique trait is the loss of normal controls which results in unregulated growth, lack of differentiation and ability to invade local tissues and metastasize. Cancer can develop in any tissue of any organ. More specifically, cancer is intended to include, without limitation, prostate cancer, leukemia, hormone dependent cancers, breast cancer, colon cancer, epidermal cancer, liver cancer, esophageal cancer, stomach cancer, hepatic carcinoma, melanoma, epidermoid carcinoma, pancreatic cancer, brain malignancies (such as neuroblastoma, glioblastoma, glioma, medulloblastoma, astrocytoma, acoustic neuroma, oligodendroglioma and meningioma), lung cancer (such as small cell lung and non-small cell lung cancer) ovarian adenocarcinoma, bladder cancer, and renal cancer.

As disclosed herein, the inventors have discovered that Thy-1 and the other recited markers are expressed in pancreatic neovasculature but not in normal pancreatic vasculature, and thus can be used to detect cancer. The inventors have also demonstrated use of the microbubbles of the invention to selectively target tumor neovasculature. The methods of this aspect of the invention thus provide early cancer detection, thus allowing earlier clinical intervention in treatment and substantially improved clinical outcome. Thus, the methods may further comprise treating the patient based on the presence of an increased number of binding complexes compared to control.

Any suitable control can be used, including but not limited to comparison to a number of binding complexes identified in a subject or population of subjects known to not have cancer. Any amount of Thy-1 or the other markers above control levels may indicate presence of cancer in the patient or indicates a risk of cancer development in the patient. In various embodiments, the increase is binding complexes is at least 10% above control, and preferably at least 25%, 50%, 100%, or more above control.

The methods can be used with patients that are at risk of having cancer, based on symptoms they presently have. The methods can also be used with patients who are at risk of developing cancer. Such risk factors include, but are not limited to, a family history of cancer and genetic disorders indicating a propensity to develop cancer.

The microbubbles can be administered by any suitable technique, including but not limited to parenterally, transmucosally (orally, nasally, or rectally) or transdermally. Parenteral administration includes, but is not limited to, intravenous, intra-arteriole, intramuscular, intradermal, subcutaneous, intraperitoneal, intraventricular, and intracranial administration. In one embodiment administration of the microbubbles is parenteral, via intravenous injection. Following administration to the patient (such as by intravenous injection), the targeted microbubbles accumulate at tumor sites that over-express Thy-1 or other marker, causing a local increase in the ultrasound imaging signal. In a preferred embodiment, microbubbles with an average diameter of between about 1 μm and 5 μm, 1 μm and 4 μm, 1 μm and 3 μm, 1 μm and about 2 μm, 2 μm and 5 μm, 2 μm and 4 μm, 2 μm and 3 μm, 3 μm and 5 μm, 3 μm and 4 μm, or about as 1 μm, 2 μm, 2.5 μm, 3 μm, 3.5 μm or 4 μm on average are intravenously injected. Due to their small size, the microbubbles stay predominantly within the vascular compartment after intravenous injection. Thus, the microbubbles can be used, for example, to exclusively detect vascular endothelial cell associated molecular markers that are present in early stage cancers or precancerous lesions.

The "conditions suitable to promote binding complex formation" used in the methods of the invention will depend on the means by which the binding molecule is labeled, the type of assay (i.e.: in vitro or in vivo), and all other relevant factors, and can be determined by one of skill in the art based on the teachings herein).

Specifics of methods for performing the ultrasound molecular imaging disclosed herein are well known to those of skill in the art; exemplary embodiments are disclosed in the examples that follow.

In a fourth aspect, the present invention provides methods for detecting pancreatic cancer in a patient, or for determining a risk for pancreatic cancer development in a patient comprising:

(a) administering a detectable Thy-1 binding molecule to a patient at risk of having or developing pancreatic cancer, under conditions suitable to promote binding complex formation between the Thy-1 binding molecule and Thy-1 present in pancreatic tumor neovasculature or a precancerous lesion; and (b) detecting the presence or absence of the binding complexes; wherein the presence of an increased number of the binding complexes compared to control is indicative of the presence of pancreatic cancer in the patient or indicates a risk of pancreatic cancer development in the patient.

In a fifth aspect, the present invention provides methods for detecting pancreatic cancer in a patient, or for determining a risk for pancreatic cancer development in a patient comprising:

(a) administering a detectable binding molecule selected from the group consisting of (i) MMRN1 binding molecules, (ii) MRC2 binding molecules, (iii) NRP1 binding molecules, and (iv) VCAM1 binding molecules, to a patient at risk of having or developing pancreatic cancer, under conditions suitable to promote binding complex formation between the binding molecule and its target present in pancreatic tumor neovasculature or a precancerous lesion; and (b) detecting the presence or absence of the binding complexes; wherein the presence of an increased number of the binding complexes compared to control is indicative of the presence of pancreatic cancer in the patient or indicates a risk of pancreatic cancer development in the patient.

As disclosed herein, the inventors have discovered that Thy-1 and the other recited markers are expressed in pancreatic neovasculature but not in normal pancreatic vasculature, and thus can be used to detect pancreatic cancer. The methods of the invention provide early detection of pancreatic cancer or precancerous lesions, thus allowing earlier clinical intervention in treatment and substantially improved clinical outcome. Thus, the methods may further comprise treating the patient based on the presence of an increased number of binding complexes compared to control.

Any suitable control can be used, including but not limited to comparison to a number of binding complexes identified in a subject or population of subjects known to not have pancreatic cancer or precancerous lesions. Any amount of Thy-1 or the other markers above control levels may indicate presence of pancreatic cancer in the patient or indicates a risk of pancreatic cancer development in the patient. In various embodiments, the increase is binding complexes is at least 10% above control, and preferably at least 25%, 50%, 100%, or more above control.

The methods can be used with patients that are at risk of having pancreatic cancer, based on symptoms they presently have, including but not limited to abdominal pain, lower back pain, heartburn, significant weight loss, Trousseau sign, pulmonary embolisms, new onset of diabetes in elderly individuals, and jaundice. The methods can also be used with patients who are at risk of developing pancreatic cancer. Such risk factors include, but are not limited to, a family history of pancreatic cancer; genetic disorders including but not limited to autosomal recessive ataxia-telangiectasia, autosomal dominantly inherited mutations in the BRCA2 gene and/or PALB2 gene, Peutz-Jeghers syndrome due to mutations in the STK11 tumor suppressor gene, hereditary non-polyposis colon cancer (Lynch syndrome), familial adenomatous polyposis, familial atypical multiple mole melanoma-pancreatic cancer syndrome (FAMMM-PC) due to mutations in the CDKN2A tumor suppressor gene; cigarette smoking, age 60 or above, and obesity.

According the methods of this aspect of the invention, the Thy-1 or other binding molecule is detectable. Any suitable technique for making the binding molecule detectable can be used, including wherein the detectable Thy-1 binding molecule comprises a detectable imaging agent selected from the group consisting of a radioactive agent (e.g., radioiodine (1251, 1310; technetium; yttrium; 35S or 3H) or other radioisotope or radiopharmaceutical; a contrast agent (e.g., gadolinium; manganese; barium sulfate; an iodinated or noniodinated agent; an ionic agent or nonionic agent); a magnetic agent or a paramagnetic agent (e.g., gadolinium, iron-oxide chelate); liposomes (e.g., carrying radioactive agents, contrast agents, or other imaging agents); nanoparticles; a positron emitting isotope for PET scanner, MRI contrast agents, and ultrasound agents (e.g., microbubble). In one embodiment, the Thy-1 or other binding molecule is present on the surface of a microbubble, including but not limited to the Thy-1 or other binding molecule containing microbubbles of the invention disclosed herein.

The binding molecules can be administered by any suitable technique, including but not limited to parenterally, transmucosally (orally, nasally, or rectally) or transdermally. Parenteral administration includes, but is not limited to, intravenous, intra-arteriole, intramuscular, intradermal, subcutaneous, intraperitoneal, intraventricular, and intracranial administration. In one embodiment administration of the binding molecules is parenteral, via intravenous injection. This embodiment is particularly preferred when the binding molecules are present on microbubbles, such as the microbubbles of the present invention. Following administration to the patient (such as by intravenous injection), the targeted microbubbles accumulate at pancreatic sites that over-express Thy-1 or other marker, causing a local increase in the ultrasound imaging signal. In a preferred embodiment, microbubbles with an average diameter of between about 1 μm and 5 μm, 1 μm and 4 μm, 1 μm and 3 μm, 1 μm and about 2 μm, 2 μm and 5 μm, 2 μm and 4 μm, 2 μm and 3 μm, 3 μm and 5 μm, 3 μm and 4 μm, or about as 1 μm, 2 μm, 2.5 μm, 3 μm, 3.5 μm or 4 μm on average are intravenously injected. Due to their small size, the microbubbles stay predominantly within the vascular compartment after intravenous injection. Thus, the microbubbles can be used, for example, to exclusively detect vascular endothelial cell associated molecular markers that are present in early stage cancers or precancerous lesions.

The "conditions suitable to promote binding complex formation" used in the methods of the invention will depend on the means by which the binding molecule is labeled, the type of assay (i.e.: in vitro or in vivo), and all other relevant factors, and can be determined by one of skill in the art based on the teachings herein.

Detection of binding molecule binding complexes with present in pancreatic neovasculature can be by any suitable means, and will depend at least in part on the means by which the binding molecule is made detectable. In one embodiment, pancreatic biopsies can be obtained and detectably labeled binding molecules can be contacted to a biopsy sample under conditions suitable to promote binding complex formation to target in the biopsy sample, and binding complexes can be detected via immunohistochemistry or other suitable technique. In another embodiment, the detection means is non-invasive, meaning that detection of the binding molecules does not require obtaining any type of sample (blood, tissue, bone, urine, or saliva) from the patient. Methods for non-invasive detection of binding molecules include magnetic resonance imaging (MRI), positron-emission tomography (PET), single photon emission tomography (SPECT) and ultrasound imaging, including, high-intensity focused ultrasound (HIFU) and contrast-enhanced ultrasound (CEUS).

In a preferred embodiment, binding molecules are present on the surface of microbubbles and are administered to a patient under conditions suitable to promote binding complex formation between target in the pancreas and the binding molecules. Detection then comprises using non-invasive contrast-enhanced ultrasound, to determine the presence or absence of the binding complexes, wherein the binding complex is only detectable in the presence of target and wherein the presence of binding complexes is indicative of the presence of pancreatic cancer, or a risk of pancreatic cancer in the patient. Non-invasive contrast-enhanced ultrasound (as well as other non-invasive detection means) can be performed so as to localize detection to the pancreas. Specifics of methods for performing the non-invasive detection techniques disclosed herein are well known to those of skill in the art.

In one embodiment, an increased number of the binding complexes compared to control is indicative of the presence of pancreatic cancer in the patient. In this embodiment, the results can be used to help direct patient treatment, including but not limited to aggressive chemotherapy and/or radiation treatments and/or surgical resection of the tumor. In one embodiment, the pancreatic cancer is pancreatic ductal adenocarcinoma. Median survival of patients with pancreatic ductal adenocarcinoma (PDAC) is less than one year; and thus the earlier detection provided by the methods of the present invention allows earlier surgical resection, which offers the best hope for longer patient survival.

In one embodiment, the presence of the binding complexes is indicative of the presence of precancerous lesions, and thus indicative of a risk of pancreatic cancer development in the patient. Pre-cancerous lesions are associated with a significantly increased risk of cancer. Non-limiting examples include cervical squamous intraepithelial lesion, ductal carcinoma in situ, Bowen's disease, colon polyps, prostatic intraepithelial neoplasia, and pancreatic intraepithelial neoplasia. In a further embodiment, the pre-cancerous cells are pre-cancerous pancreatic cells, including but not limited to pancreatic intraepithelial neoplasia form (PanIN) 1A-B, PanIN 2, and PanIN 3. These terms as defined as follows:

PanIN-1A: Pyloric gland metaplasia, goblet cell metaplasia, mucinous hypertrophy, flat duct lesion without atypia, mucinous ductal hyperplasia, simple hyperplasia, mucinous cell hyperplasia, flat ductal hyperplasia, non-papillary epithelial hypertrophy.

PanIN-1B: Papillary hyperplasia, papillary duct lesion without atypia, and ductal hyperplasia.

PanIN-2: Atypical hyperplasia, papillary duct lesion with atypia, low-grade dysplasia, and some cases of moderate dysplasia. Mucous metaplasia and pyloric gland metaplasia commonly involve small branch ducts or extend into lobules surrounding PanIN in ducts. Such involvement has been called adenomatoid or adenomatous hyperplasia, especially when the change dominates involvement of ductal epithelium. It is regarded as part of the spectrum of PanIN-1.

PanIN-3: Carcinoma in situ, intraductal carcinoma, high-grade dysplasia, severe dysplasia, and some cases of moderate dysplasia.

In this embodiment, the results can be used to help direct patient treatment, including but not limited to aggressive chemotherapy and/or radiation treatments to limit development of the lesion into a tumor.

In one embodiment, an increased number of binding complexes compared to control, wherein the binding complexes are multifocal (i.e.: scattered throughout the pancreas) indicates the presence of a precancerous lesion in the patient. In another embodiment, an increased number of binding complexes compared to control, wherein the binding complexes are focused in the pancreas (i.e.: predominately in a single location within the pancreas) indicates the presence of pancreatic cancer, such as PDAC.

In a sixth aspect the present invention provides methods for determining efficacy of pancreatic cancer therapy in a patient, comprising:

(a) administering a detectable Thy-1 binding molecule to a patient undergoing or who has previously undergone pancreatic cancer therapy, under conditions suitable to promote binding of the Thy-1 binding molecule to Thy-1 in the pancreatic tumor neovasculature to form a binding complex; and (b) detecting the presence or absence of binding complexes; wherein the presence or absence of binding complexes is indicative of the efficacy of the anti-cancer therapy in the patient.

In a seventh aspect, the present invention provides methods for determining efficacy of pancreatic cancer therapy in a patient, comprising:

(a) administering a detectable binding molecule selected from the group consisting of (i) MMRN1 binding molecules, (ii) MRC2 binding molecules, (iii) NRP1 binding molecules, and (iv) VCAM1 binding molecules, to a patient undergoing or who has previously undergone pancreatic cancer therapy, under conditions suitable to promote binding complex formation between the binding molecule and its target present in pancreatic tumor neovasculature to form a binding complex; and (b) detecting the presence or absence of the binding complexes; wherein the presence or absence of binding complexes is indicative of the efficacy of the anti-cancer therapy in the patient.

All embodiments and combinations of embodiments of the first through fifth aspects of the invention can be used in these sixth and seventh aspects. The methods of these aspects of the invention can be used, for example, to assess the growth, regression, or metastasis of the pancreatic tumor, and thus whether a patient being treated for pancreatic cancer is benefiting from therapy, or for monitoring patients who have completed treatment for recurrence of cancer.

According the methods of this aspect of the invention, the Thy-1 or other binding molecule is detectable. Any suitable technique for making the binding molecule detectable can be used, including wherein the detectable Thy-1 binding molecule comprises a detectable imaging agent selected from the group consisting of a radioactive agent (e.g., radioiodine (125I, 131O; technetium; yttrium; 35S or 3H) or other radioisotope or radiopharmaceutical; a contrast agent (e.g., gadolinium; manganese; barium sulfate; an iodinated or noniodinated agent; an ionic agent or nonionic agent); a magnetic agent or a paramagnetic agent (e.g., gadolinium, iron-oxide chelate); liposomes (e.g., carrying radioactive agents, contrast agents, or other imaging agents); nanoparticles; a positron emitting isotope for PET scanner, MRI contrast agents, and ultrasound agents (e.g., microbubble). In one embodiment, the Thy-1 or other binding molecule is present on the surface of a microbubble, including but not limited to the Thy-1 or other binding molecule containing microbubbles of the invention disclosed herein.

The binding molecules can be administered by any suitable technique, including but not limited to parenterally, transmucosally (orally, nasally, or rectally) or transdermally. Parenteral administration includes, but is not limited to, intravenous, intra-arteriole, intramuscular, intradermal, subcutaneous, intraperitoneal, intraventricular, and intracranial administration. In one embodiment administration of the binding molecules is parenteral, via intravenous injection. This embodiment is particularly preferred when the binding molecules are present on microbubbles, such as the microbubbles of the present invention. Following administration to the patient (such as by intravenous injection), the targeted microbubbles accumulate at pancreatic sites that over-express Thy-1 or other marker, causing a local increase in the ultrasound imaging signal. In a preferred embodiment, microbubbles with an average diameter of between about 1 µm and 5 µm, 1 µm and 4 µm, 1 µm and 3 µm, 1 µm and about 2 µm, 2 µm and 5 µm, 2 µm and 4 µm, 2 µm and 3 µm, 3 µm and 5 µm, 3 µm and 4 µm, or about as 1 µm, 2 µm, 2.5 µm, 3 µm, 3.5 µm or 4 µm on average are intravenously injected. Due to their small size, the microbubbles stay predominantly within the vascular compartment after intravenous injection. Thus, the microbubbles can be used, for example, to exclusively detect vascular endothelial cell associated molecular markers that are present in early stage cancers or precancerous lesions.

The "conditions suitable to promote binding complex formation" used in the methods of the invention will depend on the means by which the binding molecule is labeled, the type of assay (i.e.: in vitro or in vivo), and all other relevant factors, and can be determined by one of skill in the art based on the teachings herein).

Detection of binding molecule binding complexes with present in pancreatic neovasculature can be by any suitable means, and will depend at least in part on the means by which the binding molecule is made detectable. In one embodiment, pancreatic biopsies can be obtained and detectably labeled binding molecules can be contacted to a biopsy sample under conditions suitable to promote binding complex formation to target in the biopsy sample, and binding complexes can be detected via immunohistochemistry or other suitable technique. In another embodiment, the detection means is non-invasive, meaning that detection of the binding molecules does not require obtaining any type of sample (blood, tissue, bone, urine, or saliva) from the patient. Methods for non-invasive detection of binding molecules include magnetic resonance imaging (MRI), positron-emission tomography (PET), single photon emission tomography (SPECT) and ultrasound imaging, including, high-intensity focused ultrasound (HIFU) and contrast-enhanced ultrasound (CEUS).

In a preferred embodiment, binding molecules are present on the surface of microbubbles and are administered to a patient under conditions suitable to promote binding complex formation between target in the pancreas and the binding molecules. Detection then comprises using non-invasive contrast-enhanced ultrasound, to determine the presence or absence of the binding complexes, wherein the binding complex is only detectable in the presence of target and wherein the presence of binding complexes is indicative of the presence of pancreatic cancer, or a risk of pancreatic cancer in the patient. Non-invasive contrast-enhanced ultrasound (as well as other non-invasive detection means) can be performed so as to localize detection to the pancreas. Specifics of methods for performing the non-invasive detection techniques disclosed herein are well known to those of skill in the art.

Example 1. Ultrasonic Molecular Imaging of Thymocyte Differentiation Antigen 1 for Pancreatic Ductal Adenocarcinoma Detection Background and Aims:

Median survival of patients with pancreatic ductal adenocarcinoma (PDAC) is less than one year; earlier detection that allows surgical resection offers the best hope for longer survival. Ultrasound molecular imaging has the potential to detect neoangiogenesis markers in cancer at the molecular level with high sensitivity. We sought to identify a novel molecular marker of neoangiogenesis in PDAC and assess its potential as an imaging target for PDAC detection using ultrasound.

Methods:

Proteomic analysis followed by immunohistochemistry was performed on tissues from patients with PDAC, chronic pancreatitis, and normal pancreas to identify molecular markers differentially expressed on the neovasculature of PDAC. Thymocyte Differentiation Antigen 1 (Thy1) was identified as a novel neoangiogenesis biomarker of PDAC. To assess its utility for in vivo imaging, binding of a human Thy1-targeted ultrasound contrast agent was tested in cell culture in a flow chamber assay and in vivo in a novel orthotopic PDAC xenograft model in mice expressing human Thy1 on its neovasculature.

Results:

Vascular Thy1 expression was significantly higher in PDAC compared to chronic pancreatitis (P=0.007) and normal tissue (P<0.0001). Thy1-targeted ultrasound contrast agent showed significantly increased attachment to Thy1-positive cells compared to negative control cells (P=0.008). In vivo, Thy1-targeted ultrasound molecular imaging signal significantly increased in human Thy1-positive PDAC xenografts.

Conclusion:

Our study represents the discovery and in vivo validation of a neoangiogenesis target, Thy1, for ultrasound molecular imaging of PDAC. The development of a specific imaging agent along with the identification of Thy1 as a novel biomarker provides potential clinical utility for the diagnosis and management of human PDAC.

Introduction

Pancreatic ductal adenocarcinoma (PDAC) is the fourth leading cause of cancer death in both women and men in the USA (1). The American Cancer Society estimated 43,920 new diagnoses of PDAC and 37,390 deaths from this cancer in 2012 in the USA. Survival from pancreas cancer is stage dependent. Because the disease is most frequently detected at advanced tumor stages, patients diagnosed with PDAC have a median survival of less than one year and only 5% of patients survive five years after diagnosis (2, 3). Unfortunately, current chemotherapy and radiotherapy approaches offer only moderate survival benefits and surgery for localized disease is only possible in 15-20% of patients at the time of diagnosis (4, 5). Therefore, earlier detection of PDAC that allows potentially curable surgical resection offers our best hope to improve patient survival (6). One potential strategy for earlier detection of cancer, including PDAC, involves screening moderate and high risk patients with a highly accurate and inexpensive blood biomarker test (or combination of biomarkers) followed by a second-level, imaging-based test to confirm a positive biomarker result and anatomically localize the cancer (7). Serum CA-19-9, currently the only clinically used blood biomarker, lacks the sensitivity and, more importantly, the specificity needed to detect early-stage PDAC; active research to discover more accurate blood-based or saliva-based biomarkers is underway (8). Imaging tests are also limited in accuracy for early detection of pancreatic cancer. Currently used imaging techniques, including abdominal computed tomography (CT), magnetic resonance imaging and cholangiopancreatography (MRI/MRCP), retrograde cholangiopancreatography (ERCP), as well as trans-abdominal and endoscopic ultrasound (EUS), are often unreliable and non-specific in detecting early stage PDAC. This is particularly true regarding the detection of non-cystic precursor lesions and small size (<1 cm) foci of cancer (9, 10). Therefore, development and testing of novel imaging approaches for earlier detection of PDAC is critically needed. The vasculature of cancer, termed neovasculature, differs from normal blood vessels at the molecular and protein level (11). Molecularly-targeted contrast-enhanced ultrasound (henceforth ultrasound molecular imaging) is a promising new imaging technique with the potential to detect molecular markers overexpressed in the neovasculature of cancer (12, 13) and potentially increase the sensitivity and specificity of ultrasound in detecting early cancer. For ultrasound molecular imaging, micro-sized gas-filled contrast agents (microbubbles; MB) that are modified to bind to molecular markers are intravenously injected. After a few minutes, the MB accumulate at tissue sites that over-express the molecular target, causing a local increase in the ultrasound imaging signal and enhancing the ability to see small lesions (14). Since contrast MB are several microns in size, they remain in the intravascular space and can thus be used to exclusively detect and visualize molecular markers over-expressed on the neovasculature of precursor lesions or early stage cancer. However, similar to the blood biomarker research mentioned above, the challenge for ultrasound molecular imaging is to discover and validate imaging targets that are differentially expressed on the vasculature of PDAC versus normal pancreatic tissue and benign diseases, such as chronic pancreatitis, to maximize diagnostic accuracy in early cancer detection (13).

In this study, we exemplify a proof-of-principle approach from discovery to in vivo validation of thymocyte differentiation antigen 1 (Thy1) as a promising new ultrasound molecular imaging target in PDAC. We report on the discovery and validation of Thy1 in human tissue samples as a target for PDAC neovasculature imaging, and describe the cell culture and in vivo testing of Thy1-targeted contrast MB for ultrasound molecular imaging in a novel orthotopic mouse PDAC model expressing human Thy1 on its neovasculature.

Materials and Methods

Figure 1B:
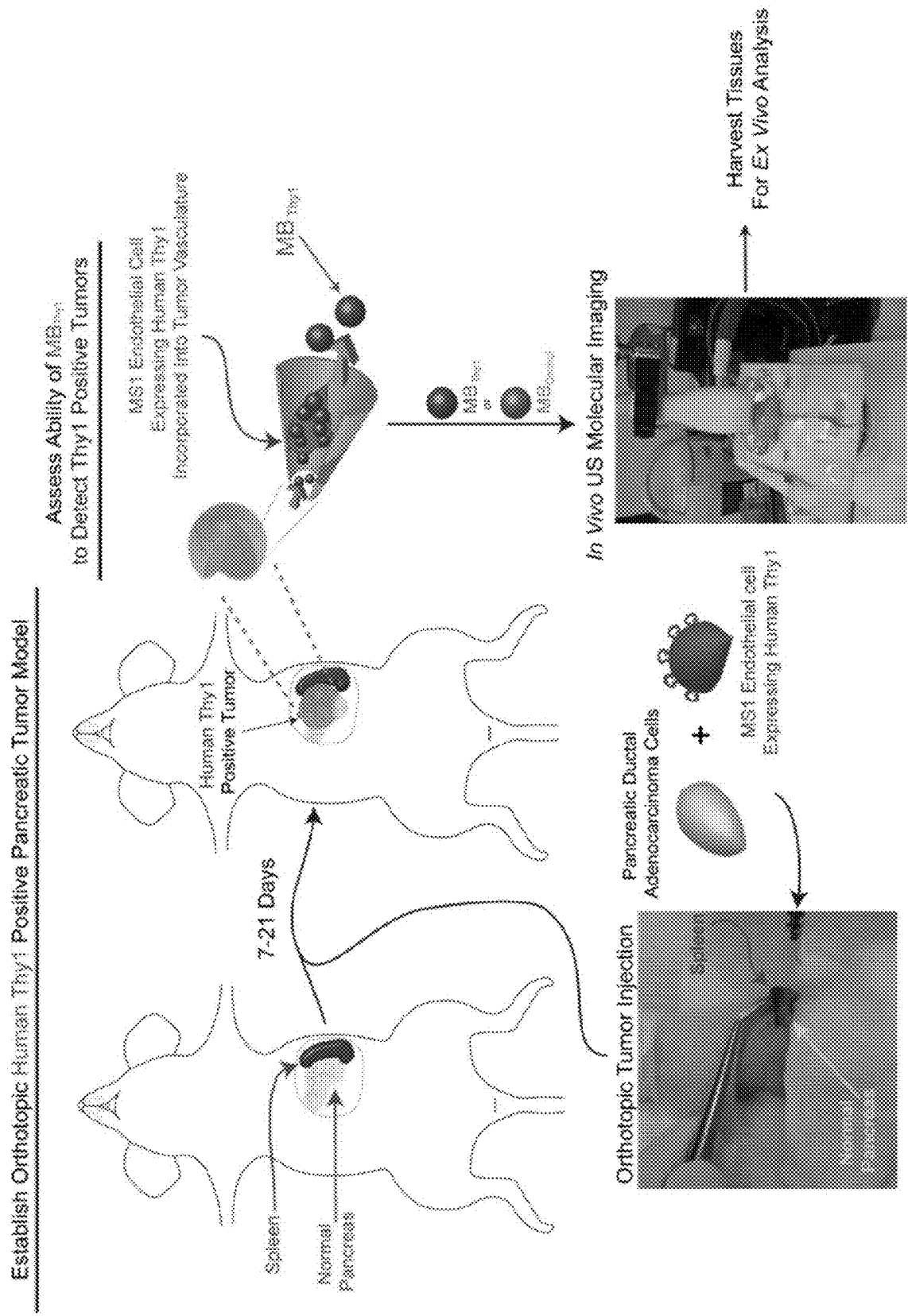

The overall experimental set up of this study is summarized in FIG. 1.

Thy1 Target Identification

Proteomic analysis was performed on whole tissues from patients with PDAC (n=5), chronic pancreatitis (n=5), and normal pancreas from donors (n=10) using a LTQ-Orbitrap™ hybrid mass spectrometer (Thermo Fisher Scientific, Waltham, Mass.) coupled with a nano-flow HPLC (Eksigent Technologies, Dublin, Calif.) as previously described 16. A total of 118 proteins were over-expressed by a factor of 2.0 or more in PDAC compared to normal pancreas. These were searched against literature reports to identify proteins associated with tumor neovasculature. To create an ultrasound molecular imaging approach using contrast MB targeting the luminal site of PDAC-associated tumor vascular endothelial cells, putative neovascular proteins were further triaged based on 1) the highest expression in cancer; 2) lack of or low expression in chronic pancreatitis tissue; 3) membrane association of the protein; and 4) assessment of protein expression in normal tissues using the Human Protein Atlas and/or published literature in PubMed, with lack of expression in normal organs being preferred. The highest rated candidate was the membrane protein Thy1 (17). Selection of Thy1 was further supported by its association with tumor vascular endothelium as previously described (18, 19).

Validation of Thy1 Expression in Human Pancreatic Tissues

Samples used in these studies were collected with Human Subjects approval at the University of Washington and Stanford University. Furthermore, a pancreatic tissue microarray was purchased from USBioMax™ (Rockville, Md.). Immunohistochemical (IHC) analysis of Thy1 expression was performed in pancreatic tissue obtained from 4 normal patients; 15 primary chronic pancreatitis tissues (defined as chronic pancreatitis not associated with PDAC); 21 PDAC; and in a commercial tissue microarray with 24 normal pancreatic tissues and 175 PDAC cases. Consecutive tissue sections were stained for the vascular endothelial cell marker CD31 and for Thy1 using standard techniques (Supplementary Materials and Methods). All slides were reviewed and graded by a pathologist, experienced in pancreatic pathology. Vascular endothelial cell staining of Thy1 was scored with a semi-quantitative IHC score from 0 to 3+ as previously described 20. In brief, cases with Thy1-staining of less than 5%, 5-32%, 33-67%, and greater than 67% of CD31 positive vessels were scored as 0, 1+, 2+, and 3+, respectively.

Human Thy1-Expressing Vascular Endothelial Cells

Murine vascular endothelial (MS1) cells stably expressing human Thy1 on the cell surface were generated using standard protocols (Supplementary Materials and Methods). Stably-transfected cells (selected by incubation with 5 µg/ml puromycin; Sigma, St. Louis, Mo.) were confirmed for Thy1 expression by flow cytometry analysis and by immunofluorescence staining using standard techniques (Supplementary Materials and Methods). For subsequent flow chamber experiments (see below), two clones with high (clone 1) and low (clone 2) human Thy1 expression were selected. Clone 1 was also used for the generation of a novel human PDAC xenograft model in mice expressing human Thy1 on its neovasculature (see below).

Preparation of Microbubble Contrast Agents

Human Thy1-targeted (MBThy1) and control (MBControl) contrast MB were prepared by attaching anti-human Thy1 antibody or isotype-matched control IgG antibody onto the surface of perfluorocarbon-containing, lipid-shelled MB as described previously 21 (Supplementary Materials and Methods). Flow cytometry analysis (incubation of targeted MB with Fluorescein-conjugated anti-biotin antibody; Jackson ImmunoResearch, 1:200) showed that the average number of attached antibodies per square micrometer of the MB surface was approximately 7,600 for both MB types.

Flow Chamber Experiments

MBThy1 binding to clones 1 and 2, as well as to wild-type negative control vascular endothelial cells was assessed in cell culture experiments under flow shear stress conditions, simulating flow in tumor capillaries, using a previously described protocol (22, 23) (Supplementary Materials and Methods).

Human Thy1-Expressing and Control Orthotopic Pancreatic Ductal Adenocarcinoma Xenografts in Mice The Administrative Panel on Laboratory Animal Care of Stanford University approved all procedures using laboratory animals. Human AsPC1 pancreatic ductal adenocarcinoma cells (ATCC, Manassas, Va.) were cultured to 70-80% confluency in Dulbecco's modified Eagle's medium (DMEM; supplemented with 10% (vol/vol) fetal bovine serum; penicillin (100 U/mL); and streptomycin (100 μg/mL); Invitrogen) at 37° C. in 5% CO2 and 95% air atmosphere before trypsinization. After midline laparotomy, the pancreas of the mice was exposed, and AsPC1 cells along with clone 1 cells at 1:5 ratio (total of $6 \times 10^6$ cells, dissolved in 25 μl of Matrigel™ containing epidermal growth factor (0.7 ng/mL), insulin-like growth factor (16 ng/ml), and transforming growth factor-beta (2.3 ng/ml); BD Biosciences, San Jose, Calif.) co-injected into the body or tail of the pancreas in 25 female nude mice (6-8 weeks old; Charles River, Wilmington, Mass.) into the body or tail of the pancreas. In negative control animals (n=14), AsPC1 cells alone (n=7) or combined with wild-type cells (n=7) were co-injected at the above-mentioned ratio. The abdomen was then closed by layers. Orthotopic xenografts were allowed to grow between 7 and 21 days to yield a spectrum of different tumor sizes with volumes ranging between 100 and 1304 mm$^3$ (mean, 403 mm$^3$) as measured by B-mode ultrasound and using the formula for a prolate ellipsoid (π/6×length×width×height).

In Vivo Ultrasound Molecular Imaging of Pancreatic Ductal Adenocarcinoma Xenografts All ultrasound molecular imaging was performed using a dedicated small animal ultrasound machine; the technical specifications are detailed in the Supplementary Materials and Methods. In all PDAC xenografts, intra-animal comparisons of ultrasound imaging signals were performed following injection of both MBThy1 and MBControl in a randomized order during the same imaging session. Four minutes following tail vein injection of either MBThy1 or MBcontrol ($5 \times 10^7$; bolus injected within 2 seconds through a tail vein catheter), 250 imaging frames were acquired of each tumor within 25 seconds (22, 23). This was followed by a one-second destruction pulse to destroy all MB in the field-of-view (destruction pulse of 3.7 MPa; transmit power, 100%; mechanical index, 0.63). Nine seconds after the destruction pulse, another 250 imaging frames were acquired to capture the influx of freely circulating MB. After a waiting time of at least 30 minutes to allow MB to clear from previous injection (24, 25), this imaging sequence was repeated following intravenous injection of $5 \times 107$ MB of the second MB type of either MBThy1 or MBControl, with the transducer maintained at the same anatomical location. Furthermore, an in vivo competition assay with anti-human Thy1 antibodies was performed using mouse anti-human Thy1 antibody (100 μg; eBioscience; San Diego, Calif.) as described previously (22, 23).

Imaging Analysis of In Vivo Ultrasound Molecular Imaging

Ultrasound molecular imaging was analyzed offline using dedicated software with motion compensation capabilities (VevoCQ, Visualsonics; Toronto, Canada). The imaging signal (expressed in arbitrary units, a.u.) from attached MB was defined as the difference between pre- and post-destruction imaging signals as described 23. Regions of interest were draws over the different tumors and over adjacent normal pancreas tissue by one reader, blinded to the types of MB (MBThy1 vs. MBControl) and tumor (positive vs. control tumors).

Ex Vivo Analysis of Pancreatic Ductal Adenocarcinoma Xenografts

To confirm expression of human Thy1 on vascular endothelial cells of the tumor neovasculature in mice, all tumors were excised after ultrasound imaging and immunostained for human Thy1 and mouse CD31 according to standard protocols (Supplementary Materials and Methods); AsPC1 tumors were also stained for murine Thy1.

Statistical Analysis

All continuous measurements were expressed as means±standard deviation. Differences in the Thy1 expression levels between groups of patient samples were tested for statistical significance using the Mann-Whitney test. Empirical receiver operating characteristic (ROC) curves were used to determine the sensitivity and specificity of Thy1 in separating PDAC from non-cancer controls. The two-sample Wilcoxon test was used for pair-wise comparisons of measurements in flow chamber experiments. For comparison between MBThy1 vs. MBControl in the same tumor and for competition assays, the one-sample paired Wilcoxon test was used. The two-sample t-test was used for comparisons in multiple groups (Thy1-positive and two control tumor types). For assessing associations between Thy1-expression levels and cell attachment, Spearman's correlation coefficient was estimated and the corresponding P-value was obtained based on Fisher's transformation. Statistical analyses of Thy1 IHC scores were performed using GraphPad Prism (La Jolla, Calif.); the remainder of the statistical analyses was performed with R 2.10.1 with a significance level of 0.05.

Results

Validation of Thy1 Expression in Human Pancreatic Tissues

Figures 2A, 2B, 2C:
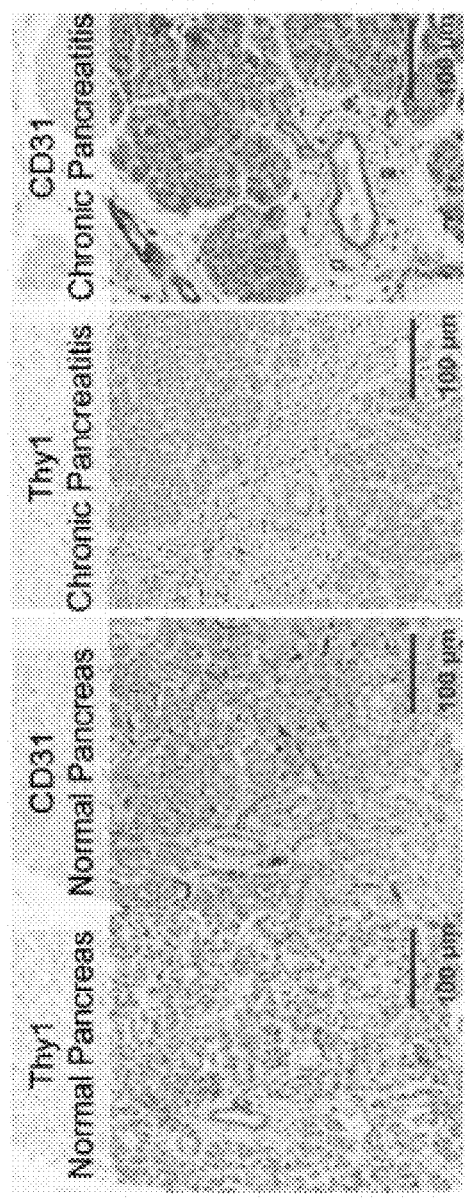
FIG. 2A-2C. Immunohistochemistry (IHC) analysis of Thy1 staining in human pancreatic tissue samples. Examples of normal pancreas (FIG. 2A) and primary chronic pancreatitis (FIG. 2B) with no Thy1 staining on vasculature.

To verify the expression of Thy1 in PDAC-associated neovasculature in humans, IHC was performed on pancreatic tissue samples from normal pancreas (n=28), primary chronic pancreatitis (n=15) and PDAC patients (n=199). The expression of Thy1 was essentially restricted to the neovasculature associated with PDAC, with occasional staining of the peritumoral stromal compartment. There was no expression within the neoplastic epithelium in most of the cases; therefore, only vascular staining (guided by CD31 staining) was evaluated. The expression of Thy1 was significantly increased in the PDAC patients (score, 2.1±0.1) and was minimal in normal controls (0.5±0.1; P<0.0001) and primary chronic pancreatitis (0.6±0.15; P=0.007) (FIGS. 2A-C). Considering IHC scores of 2+ or 3+ as positive staining, 81% of PDAC cases stained positive for Thy1 while normal pancreas and chronic pancreatitis cases were positive in 11% and 7%, respectively. ROC analysis indicated that Thy1 neovascular immunostaining could distinguish PDAC from normal and chronic pancreatitis tissues with 90% specificity and 81% sensitivity [area under curve (AUC) value=0.89].

Microbubble Binding in Flow Chamber Experiments

Figure 4:
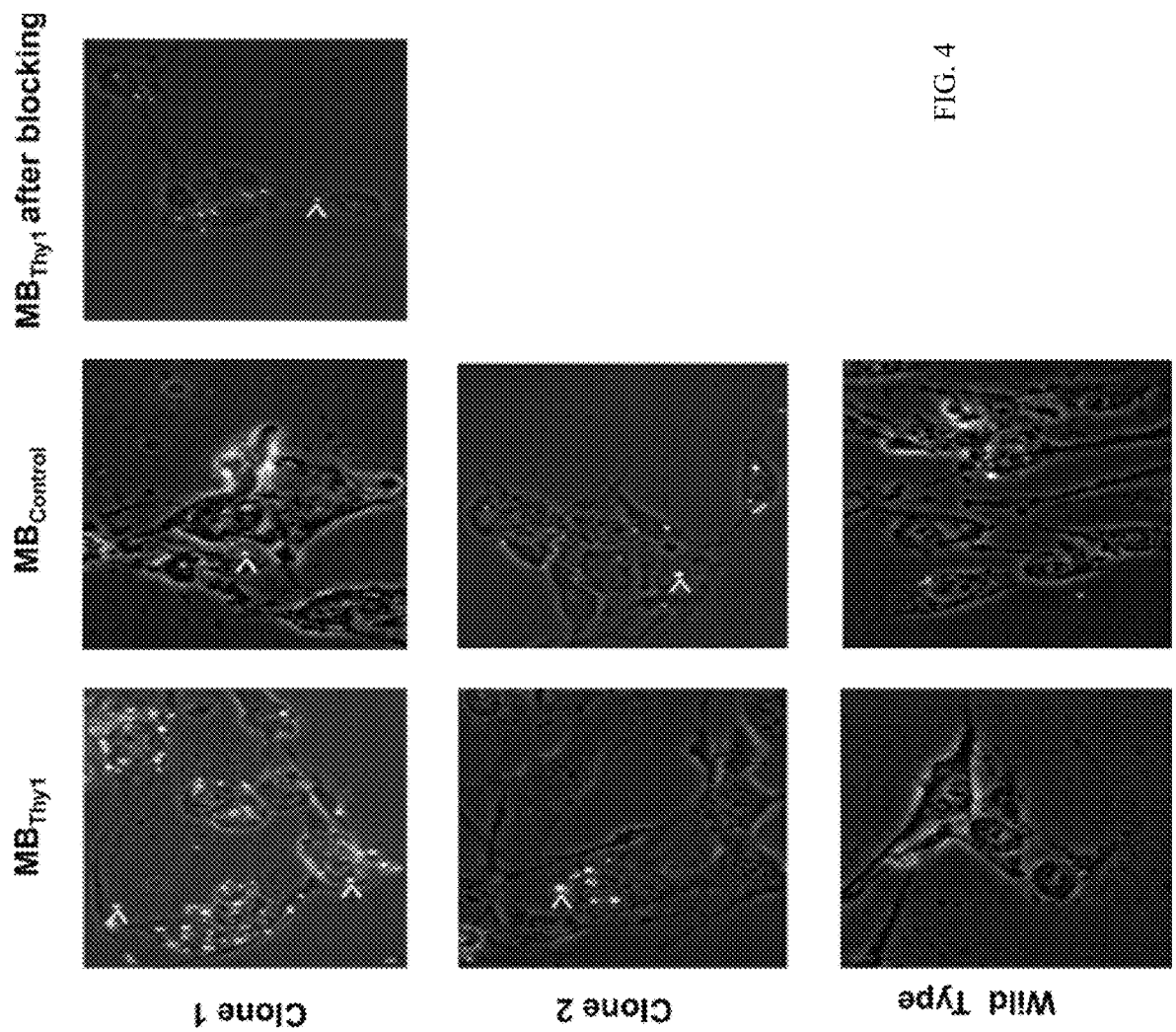
FIG. 4. Dynamic cell culture binding assay of microbubbles (MB) in a parallel plate flow chamber setting. Phase-contrast bright-field micrographs show binding of MBThy1 and MBControl (white spheres, arrowheads) to different cell types; binding could be substantially blocked by incubation of cells beforehand with an anti-human Thy1 antibody (quantitative date in Table 5).

Mouse neovascular endothelial cells do not express human Thy1, thus to recapitulate the protein expression of Thy1 in human PDAC neovasculature, we created two mouse vascular endothelial cell lines with different expression levels of human Thy1 (clone 1 and clone 2) and confirmed the Thy1 expression levels by fluorescence microscopy (FIG. 3A), and FACS analysis (FIG. 3B, C). Table 5 summarizes binding of MBThy1 and MBControl to clone 1 (high human Thy1 expression), clone 2 (low human Thy1 expression) and to wild-type vascular endothelial cells (no Thy1 expression) in flow chamber experiments. Binding of MBThy1 to both clone 1 (P=0.008) and clone 2 (P=0.01) was significantly higher than binding to wild-type endothelial cells (FIG. 4). Blocking of Thy1 receptors with anti-Thy1 antibodies resulted in significantly decreased MBThy1 attachment (P=0.03), confirming binding specificity of MBThy1 to human Thy1. In contrast, compared to MBThy1, MBControl only demonstrated background attachment to all three cell types without statistically significant difference of MBControl attachment among the three different cell types (P≥0.5). The number of attached MBThy1 highly correlated with the expression levels of Thy1 on vascular endothelial cells (rho=0.92, P<0.001).

TABLE 5

Binding of Microbubbles to Vascular Endothelial (MS1) Cells with Different Expression Levels of Human Thy1.

| | $MB_{Thy1}$ | $MB_{Control}$ | $MB_{Thy1}$ after blocking |
|---|---|---|---|
| High Thy1 expression (clone 1) | 4.4 ± 2.0 | 0.8 ± 0.3 | 0.7 ± 0.3 |
| Low Thy1 expression (clone 2) | 1.8 ± 0.5 | 0.9 ± 0.5 | NA |
| No Thy1 expression (wild-type) | 0.6 ± 0.4 | 0.6 ± 0.2 | NA |

Data are means ± standard deviation of attached microbubbles (MB) per cell.
Note blocking was performed by incubating cells with anti-human Thy1 antibody.

Figure 5:
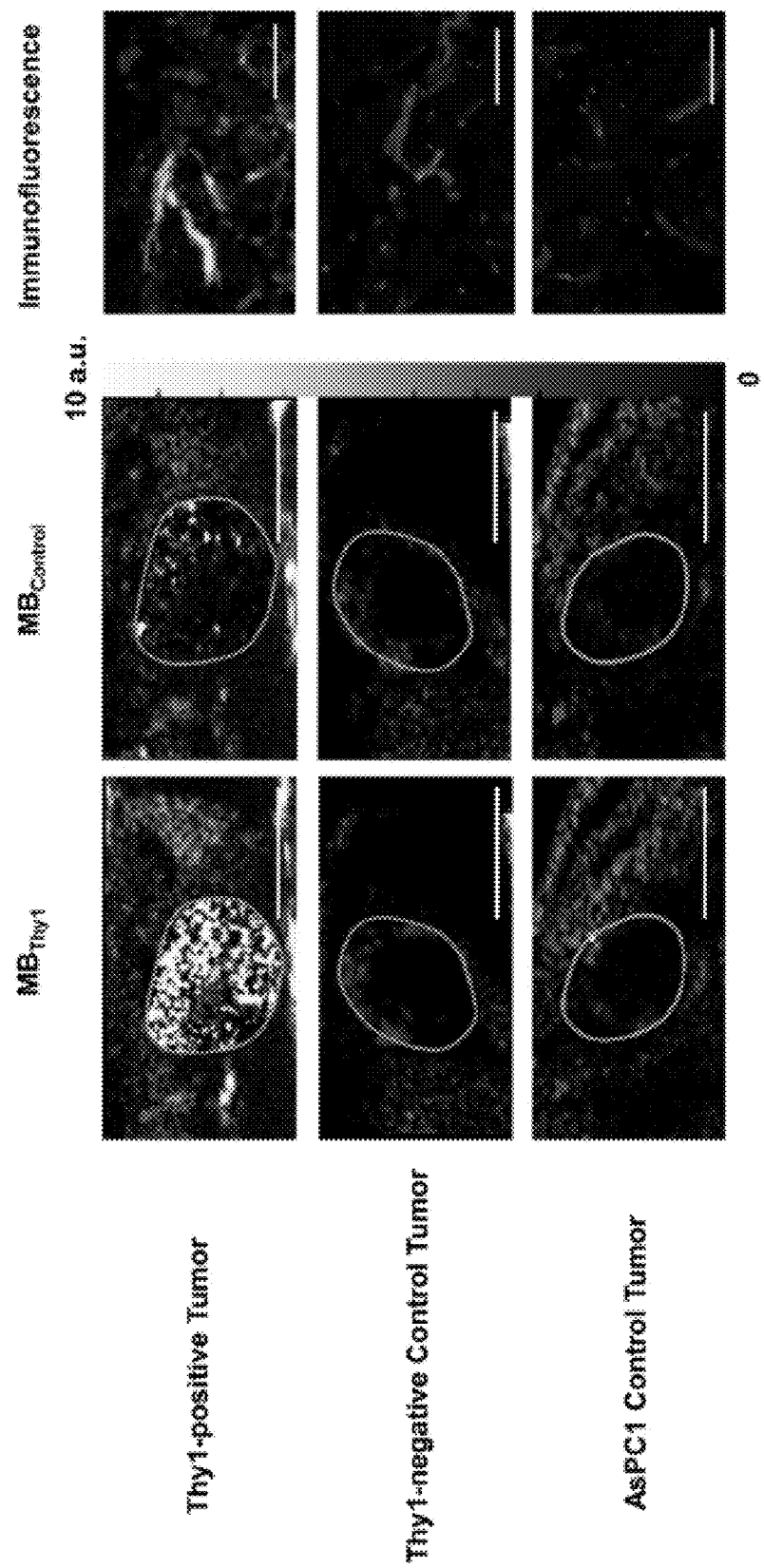
FIG. 5. In vivo ultrasound molecular imaging of orthotopic PDAC xenografts in mice and corresponding ex vivo immunofluorescence analysis. Transverse ultrasound images obtained in contrast mode following intravenous injection of MBThy1 and MBControl show strong imaging signal in human Thy1-positive tumor and background signal in both types of control tumors (scale bar=5 mm; scale is shown for molecular ultrasound imaging signal in arbitrary units, a.u.). Note low imaging signal following MBControl in all tumor types (circles, region of interest). Corresponding immunofluorescence micrographs of merged double-stained sections (murine CD31, red; human thy 1, green) confirm human Thy1 expression on neovasculature in Thy1-positive tumors (yellow) while both negative control tumors did not show human Thy1 staining on the neovasculature (scale bar=50 μm).

In Vivo Ultrasound Molecular Imaging in Pancreatic Ductal Adenocarcinoma Xenografts in Mice To prove binding of MBThy1 to human Thy1 in vivo, we developed a novel orthotopic PDAC xenograft mouse model by co-injecting AsPC1 cells with mouse vascular endothelial cells expressing human Thy1. As negative control tumors, either AsPC1 cells only or AsPC1 cells mixed with human Thy1-negative endothelial cells were injected orthotopically into the pancreas in mice. Growth rates among the different tumor types were not significantly different (P>0.05) and tumors over a broad size spectrum between 100 and 1304 mm3 were images. Imaging enhancement of Thy1-positive tumors (n=25) was significantly increased (P<0.001) following injection of MBThy1 compared to MBControl (FIG. 5; Table 6). Control xenografts (n=14) and normal pancreas tissue adjacent to the three different tumor types (n=39) showed significantly lower imaging signal using MBThy1 (Table 6). In vivo competition assay (n=7) using antihuman Thy1 antibodies resulted in a significant decrease (P=0.008) of human Thy1-targeted imaging signal in Thy1-positive xenografts, which further confirmed binding specificity of MBThy1 to human Thy1 in vivo.

TABLE 6

Summary of Ultrasound Molecular Imaging Signals in Three Different Types of Orthotopic Pancreatic Ductal Adenocarcinoma Xenografts and Control Pancreas Tissue inMice using Human Thy1-targeted Microbubbles (MBThy1) and Control Microbubbles (MBcontrol).

| | $MB_{Thy1}$ | $MB_{Control}$ | P ($MB_{Thy1}$ vs. $MB_{Control}$) |
|---|---|---|---|
| Thy1-positive tumors (n = 25) | 7.7 ± 2.3 | 1.4 ± 2.2 | <0.001 |
| Thy1-negative control tumors (n = 7) | 1.9 ± 1.8 | 1.9 ± 1.7 | 1.0 |
| AsPC1 only control tumors (n = 7) | 1.7 ± 1.6 | 1.4 ± 0.6 | 0.68 |
| Adjacent normal pancreas tissue (n = 39) | 1.7 ± 1.6 | 1.6 ± 2.2 | 0.37 |
| P (Thy1-postive vs. Thy1-negative tumors) | 0.001 | 0.54 | |
| P (Thy1-positive vs. AsPC1 only tumors) | <0.001 | 0.06 | |
| P (Thy1-negative vs. AsPC1 only tumors) | 0.82 | 0.56 | |
| P (Thy1-positive vs. normal pancreas) | <0.001 | 0.18 | |
| P (Thy1-negative vs. normal pancreas) | 0.81 | 0.74 | |
| P (AsPC1 tumors vs. normal pancreas) | 0.98 | 0.69 | |

Data are means ± standard deviation of ultrasound molecular imaging signal in arbitrary units.
AsPC1 is a human pancreatic ductal adenocarcinoma cell line.

After imaging, xenografts were excised and stained for human Thy1 and mouse CD31. Merged immunofluorescent images confirmed overexpression of human Thy1 on the neovasculature in Thy1-positive xenografts while there was no human or mouse Thy1 expression observed in Thy1-negative and AsPC1-only xenografts.

Discussion

There is a great need for inexpensive and highly accurate imaging of lethal cancers such as PDAC. Earlier detection of cancer is limited, in part, by the availability and cost of the diagnostic test. Ultrasound fulfills many prerequisites for becoming a promising imaging tool for early cancer detection: It is noninvasive and inexpensive compared to other imaging modalities; does not use ionizing irradiation; has a very high spatial and temporal (real-time exam) resolution (26-28); provides deep tissue penetration (e.g., compared to optical based approaches); and is routinely available in almost all clinical imaging departments worldwide. Several morphological imaging criteria of pre-invasive or early PDAC have been described on endoscopic ultrasound, including parenchymal heterogeneity, echogenic foci, and hypoechogenic nodules (29). However, these findings are very subtle, require interpretation by expert endosonographers, and are often nonspecific compared to chronic pancreatitis, and therefore must be interpreted with caution (29). Indeed, in a recent study the inter-observer agreement of (17) expert endosonographers interpreting endoscopic US scans in high risk patients for PDAC was only fair to poor and did not improve even on consensus interpretations (30). Adding molecular imaging capabilities to future clinical ultrasound scans may substantially increase the diagnostic accuracy of ultrasound imaging in detecting early neoplastic pancreatic lesions at little additional cost to the procedure (12). However, this requires identification of molecular imaging targets that allow differentiation of normal from precancerous or malignant pancreatic tissue. Furthermore, these molecular markers must be cancer-specific enough to allow differentiation of malignant from benign lesions to minimize false-positive results, thereby decreasing the number of unnecessary biopsies or surgical interventions.

The goal of this proof-of-principle study was to discover and validate a PDAC associated protein that can be used as an imaging target for ultrasound molecular imaging of the pancreas and that may increase diagnostic accuracy of ultrasound in earlier detection of PDAC. Since most current ultrasound contrast agents remain exclusively within the vascular compartment, molecular imaging targets for ultrasound need to be expressed on the luminal site of vascular endothelial cells of the pancreatic neovasculature. Through quantitative proteomic analysis and several prioritizing steps, we identified Thy1, a membrane protein, as a promising new tissue marker for ultrasound molecular imaging expressed on PDAC-associated neovasculature.

Thy1, also known as cluster of differentiation 90 (CD90), is a cell-surface glycoprotein that belongs to the immunoglobulin-like supergene family (31). While Thy1 was originally described as a marker for thymocyte differentiation in mice (32), it was later found to be expressed on various other tissues 15 and up-regulated on the surface of newly formed blood vessels (33). Our immunohistochemical validation study demonstrated positive Thy1 expression on the neovasculature of 81% of human pancreatic adenocarcinoma samples while there was minimal Thy1 staining in normal pancreatic tissue. Chronic pancreatitis samples showed marginally higher Thy1 staining than normal pancreas, but significantly lower Thy1 staining than PDAC. Some Thy1 staining in chronic pancreatitis cases is expected because Thy1 expression had been associated with inflammatory tissues in previous studies. For example, in rat models of inflammation including a renal ischemia model following renal artery ligation, and in a balloon injury model of the carotid arteries, Thy1 has been shown to be overexpressed on angiogenic vessels (37).

In that study, vascular microvessel exposure with necrosis factor-α and interleukin-1β stimulated cellular Thy1 expression, suggesting that inflammatory cytokines may increase Thy1 expression (37). Chronic pancreatitis is characterized by fibroinflammatory changes to the pancreatic tissue with variable extents of superimposed acute inflammatory changes depending on the etiology and the stage of the disease (38). Such active inflammation may have stimulated Thy1 expression in some of our chronic pancreatic cases. After identification and validation of Thy1 as a promising molecular imaging target for PDAC, we designed a new contrast MB targeted to human Thy1. In flow chamber experiments that simulated shear stress flow in tumor capillaries, we confirmed binding specificity of MBThy1 to Thy1-positive vascular endothelial cells and showed good correlation between the number of cell-attaching contrast MB and the number of Thy1 receptors expressed on the cell surface of vascular endothelial cells as assessed by flow cytometry. To further test the performance of MBThy1 to image human Thy1 expression in vivo, an animal model expressing human Thy1 on the tumor vasculature was needed. Since in animal xenograft models the tumor vasculature from sprouting angiogenic vessels is derived from the host (e.g., murine vessels in xenografts in mice), we expected that human Thy1 would not be expressed on tumor angiogenic vessels after injection of human PDAC cells into the mice. Immunohistochemical analysis of several subcutaneous human PDAC xenografts (using human AsPC1, CaPan2, and PANC1 pancreatic adenocarcinoma cells) confirmed no human or murine Thy1 expression on the tumor vasculature. This necessitated the design of a novel mouse PDAC model with tumor vessels expressing the human Thy1 receptor on the vascular cell surface. Embedding spheroids containing human umbilical vein endothelial cells in a Matrigel-fibrin matrix has been previously shown to generate a functional three-dimensional human vascular network in severe combined immunodeficiency mice (39, 40). We modified this approach by directly co-injecting mouse vascular endothelial MS1 cells stably expressing human Thy1 along with human PDAC cells embedded in a Matrigel matrix enriched with growth factors. MS1 cells are murine pancreatic microvasculature cells transduced with a temperature-sensitive simian virus 40 large T antigen (41). When injected into immunocompromised mice, these cells form benign, maximum 2-mm3 hemangiomas (41). In our study, coinjection of AsPC1 cells along with MS1 cells resulted in neovasculature with Thy1-expressing MS1 cells aligning along newly forming tumor vessels. This was confirmed by ex vivo immunofluorescence staining of Thy1-positive tumors which showed co-localization of Thy1 with the vascular endothelial cell marker CD31. Negative control tumors had no Thy1 staining. To the best of our knowledge, this mouse model is the first to show that a human neoangiogenesis receptor can be expressed on the neovasculature of a murine tumor model by using a straight forward co-injection technique of modified vascular endothelial and tumor cells along with tissue matrix and growth factors. In the future, this new mouse model may provide versatility for in vivo testing of neoangiogenesis-targeted ultrasound contrast agents in mice by simply replacing the human Thy1 gene by any other human-specific receptor gene. In our study, we confirmed feasibility of in vivo human Thy1 visualization with ultrasound imaging in this new animal model. In orthotopically implanted Thy1-positive tumors in the pancreas, injection of MBThy1 resulted in an about 4-5.5-fold higher imaging signal compared to control conditions. While the goal of our study was not to determine the smallest detectable size of PDAC, Thy1 expressing tumors down to a size of 100 mm$^3$ could be visualized with ultrasound molecular imaging.

In conclusion, our proof-of-principle study illustrates the development and testing process of neovascular protein target discovery and validation in human pancreatic tissues to testing of in vivo ultrasound molecular imaging properties of new human Thy1-targeted microbubble in a novel orthotopic human PDAC model in mice that expresses human Thy1 on angiogenic vessels.

REFERENCES

1. Siegel R, Naishadham D, Jemal A. Cancer statistics, 2012. CA: A Cancer Journal for Clinicians 2012; 62:10-29.
2. Sakorafas G H, Smyrniotis V. Molecular biology of pancreatic cancer: how useful is it in clinical practice? JOP 2012; 13:332-7.
3. Shaib Y H, Davila J A, El-Serag H B. The epidemiology of pancreatic cancer in the United States: changes below the surface. Aliment Pharmacol Ther 2006; 24:87-94.
4. Baine M J, Chakraborty S, Smith L M, Mallya K, Sasson A R, Brand R E, Batra S K. Transcriptional profiling of peripheral blood mononuclear cells in pancreatic cancer patients identifies novel genes with potential diagnostic utility. PLoS One 2011; 6:e17014.
5. Habisch H, Zhou S, Siech M, Bachem M G. Interaction of Stellate Cells with Pancreatic Carcinoma Cells. Cancers 2010; 2:1661-1682.

6. Singh P, Srinivasan R, Wig J D. Major molecular markers in pancreatic ductal adenocarcinoma and their roles in screening, diagnosis, prognosis, and treatment. Pancreas 2011; 40:644-52.
7. Lutz A M, Willmann J K, Drescher C W, Ray P, Cochran F V, Urban N, Gambhir S S. Early diagnosis of ovarian carcinoma: is a solution in sight? Radiology 2011; 259:329-45.
8. Liang J J, Kimchi E T, Staveley-O'Carroll K F, Tan D. Diagnostic and prognostic biomarkers in pancreatic carcinoma. Int J Clin Exp Pathol 2009; 2:1-10.
9. Ariyama J, Suyama M, Satoh K, Sai J. Imaging of small pancreatic ductal adenocarcinoma. Pancreas 1998; 16:396-401.
10. Verna E C, Hwang C, Stevens P D, Rotterdam H, Stavropoulos S N, Sy C D, Prince M A, Chung W K, Fine R L, Chabot J A, Frucht H. Pancreatic cancer screening in a prospective cohort of highrisk patients: a comprehensive strategy of imaging and genetics. Clinical Cancer Research 2010; 16:5028-37.
11. Cao Y. Tumor angiogenesis and molecular targets for therapy. Front Biosci 2009; 14:3962-73.
12. Gessner R, Dayton P A. Advances in molecular imaging with ultrasound. Mol Imaging 2010; 9:117-27.
13. Pysz M A, Willmann J K. Targeted Contrast-Enhanced Ultrasound: An Emerging Technology in Abdominal and Pelvic Imaging. Gastroenterology 2011.
14. Sirsi S R, Flexman M L, Vlachos F, Huang J, Hernandez S L, Kim H K, Johung T B, Gander J W, Reichstein A R, Lampl B S, Wang A, Hielscher A H, Kandel J J, Yamashiro D J, Borden M A. Contrast ultrasound imaging for identification of early responder tumor models to antiangiogenic therapy. Ultrasound in Medicine and Biology 2012; 38:1019-29.
15. Bradley J E, Ramirez G, Hagood J S. Roles and regulation of Thy-1, a context-dependent modulator of cell phenotype. Biofactors 2009; 35:258-65.
16. Pan S, Chen R, Stevens T, Bronner M P, May D, Tamura Y, McIntosh M W, Brentnall T A. Proteomics portrait of archival lesions of chronic pancreatitis. PLoS One 2011; 6:e27574.
17. Tse A G, Barclay A N, Watts A, Williams A F. A glycophospholipid tail at the carboxyl terminus of the Thy-1 glycoprotein of neurons and thymocytes. Science 1985; 230:1003-8.
18. Risau W. Angiogenesis is coming of age. Circulation Research 1998; 82:926-8.
19. St Croix B, Rago C, Velculescu V, Traverso G, Romans K E, Montgomery E, Lal A, Riggins G J, Lengauer C, Vogelstein B, Kinzler K W. Genes expressed in human tumor endothelium. Science 2000; 289:1197-202.
20. Chen R, Yi E C, Donohoe S, Pan S, Eng J, Cooke K, Crispin D A, Lane Z, Goodlett D R, Bronner M P, Aebersold R, Brentnall T A. Pancreatic cancer proteome: the proteins that underlie invasion, metastasis, and immunologic escape. Gastroenterology 2005; 129:1187-97.
21. Willmann J K, Paulmurugan R, Chen K, Gheysens O, Rodriguez-Porcel M, Lutz A M, Chen I Y, Chen X, Gambhir S S. US imaging of tumor angiogenesis with microbubbles targeted to vascular endothelial growth factor receptor type 2 in mice. Radiology 2008; 246:508-18.
22. Deshpande N, Ren Y, Foygel K, Rosenberg J, Willmann J K. Tumor angiogenic marker expression levels during tumor growth: longitudinal assessment with molecularly targeted microbubbles and US imaging. Radiology 2011; 258:804-11.
23. Pysz M A, Foygel K, Rosenberg J, Gambhir S S, Schneider M, Willmann J K. Antiangiogenic cancer therapy: monitoring with molecular US and a clinically translatable contrast agent (BR55). Radiology 2010; 256:519-27.
24. Willmann J K, Cheng Z, Davis C, Lutz A M, Schipper M L, Nielsen C H, Gambhir S S. Targeted microbubbles for imaging tumor angiogenesis: assessment of whole-body biodistribution with dynamic micro-PET in mice. Radiology 2008; 249:212-9.
25. Anderson C R, Hu X, Zhang H, Tlaxca J, Decleves A E, Houghtaling R, Sharma K, Lawrence M, Ferrara K W, Rychak J J. Ultrasound molecular imaging of tumor angiogenesis with an integrin targeted microbubble contrast agent. Investigative Radiology 2011; 46:215-24.
26. Dickinson M E. Multimodal imaging of mouse development: tools for the postgenomic era. Dev Dyn 2006; 235:2386-400.
27. Willmann J K, van Bruggen N, Dinkelborg L M, Gambhir S S. Molecular imaging in drug development. Nat Rev Drug Discov 2008; 7:591-607.
28. Lindner J R. Molecular imaging of myocardial and vascular disorders with ultrasound. JACC Cardiovasc Imaging 2010; 3:204-11.
29. Brentnall T A. Management strategies for patients with hereditary pancreatic cancer. Curr Treat Options Oncol 2005; 6:437-45.
30. Topazian M, Enders F, Kimmey M, Brand R, Chak A, Clain J, Cunningham J, Eloubeidi M, Gerdes H, Gress F, Jagannath S, Kantsevoy S, LeBlanc J K, Levy M, Lightdale C, Romagnuolo J, Saltzman J R, Savides T, Wiersema M, Woodward T, Petersen G, Canto M. Interobserver agreement for EUS findings in familial pancreatic-cancer kindreds. Gastrointest Endosc 2007; 66:62-7.
31. Williams A F. Immunoglobulin-related domains for cell surface recognition. Nature 1985; 314:579-80.
32. Reif A E, Allen J M. The Akr Thymic Antigen and Its Distribution in Leukemias and Nervous Tissues. J Exp Med 1964; 120:413-33.
33. Gordon J W, Chesa P G, Nishimura H, Rettig W J, Maccari J E, Endo T, Seravalli E, Seki T, Silver J. Regulation of Thy-1 gene expression in transgenic mice. Cell 1987; 50:445-52.
34. Madden S L, Cook B P, Nacht M, Weber W D, Callahan M R, Jiang Y, Dufault M R, Zhang X, Zhang W, Walter-Yohrling J, Rouleau C, Akmaev V R, Wang C J, Cao X, St Martin T B, Roberts B L, Teicher B A, Klinger K W, Stan R V, Lucey B, Carson-Walter E B, Laterra J, Walter K A. Vascular gene expression in nonneoplastic and malignant brain. Am J Pathol 2004; 165:601-8.
35. Chen X, Higgins J, Cheung S T, Li R, Mason V, Montgomery K, Fan S T, van de Rijn M, So S. Novel endothelial cell markers in hepatocellular carcinoma. Mod Pathol 2004; 17:1198-210.
36. Buckanovich R J, Sasaroli D, O'Brien-Jenkins A, Botbyl J, Hammond R, Katsaros D, Sandaltzopoulos R, Liotta L A, Gimotty P A, Coukos G. Tumor vascular proteins as biomarkers in ovarian cancer. J Clin Oncol 2007; 25:852-61.
37. Lee W S, Jain M K, Arkonac B M, Zhang D, Shaw S Y, Kashiki S, Maemura K, Lee S L, Hollenberg N K, Lee M E, Haber E. Thy-1, a novel marker for angiogenesis unregulated by inflammatory cytokines. Circ Res 1998; 82:845-51.
38. Kloppel G. Chronic pancreatitis, pseudotumors and other tumor-like lesions. Mod Pathol 2007; 20 Suppl 1:S113-31.

39. Alajati A, Laib A M, Weber H, Boos A M, Bartol A, Ikenberg K, Korff T, Zentgraf H, Obodozie C, Graeser R, Christian S, Finkenzeller G, Stark G B, Heroult M, Augustin H G. Spheroid-based engineering of a human vasculature in mice. Nat Methods 2008; 5:439-45.

40. Laib A M, Bartol A, Alajati A, Korff T, Weber H, Augustin H G. Spheroid-based human endothelial cell microvessel formation in vivo. Nat Protoc 2009; 4:1202-15.

41. Arbiser J L, Moses M A, Fernandez C A, Ghiso N, Cao Y, Klauber N, Frank D, Brownlee M, Flynn E, Parangi S, Byers H R, Folkman J. Oncogenic H-ras stimulates tumor angiogenesis by two distinct pathways. Proc Natl Acad Sci USA 1997; 94:861-6.

Supplemental Material and Methods

Immunohistochemistry of Thy1 and CD31 Expression

Immunohistochemistry was performed on standard serial sections of paraffin-embedded pancreatic tissue slices and microarrays. Briefly, prior to incubation with the primary antibody, sections were pre-treated with CC1 antigen retrieval solution (Ventana, Tucson, Ariz.). Thereafter, primary antibody to human CD31 (no dilution; Ventana Medical Systems, catalog 760-4378) and human Thy1 (1:100 dilution; Novus Biologicals, catalog NBP1-42068) was applied at 37° C. for 16 min followed by counter staining by Hematoxylin. Labeling was performed on an ES automatic immunohistochemical stainer (Ventana Medical Systems). Slides were imaged using Aperio Imagescope.

Murine Vascular Endothelial Cells Stably Expressing Human Thy1

The human Thy1 DNA sequence (gi|224589802: c119294246-119288655) was first optimized for mammalian codon usage as described[1] and then synthesized into double-stranded DNA. Restriction sites, XhoI (5') and Nhe-I (3') were added onto the amplified Thy1 double-stranded DNA using primers. The flanked Thy1 sequence was then cloned into pCR-BluntII-Topo™ vector (Invitrogen, Carlsbad, Calif.), amplified by colony PCR (one-step inactivation of chromosomal genes in Escherichia coli K-12 using PCR products), and verified by sequencing. Flanked (Xho-I (5') and Nhe-I (3')) Thy1 was then subcloned into pcDNA3.1 (Invitrogen), modified by substitution of CMV for an ubiquitin promoter and neomycin for puromycin resistance selection gene. Thy1-pcDNA was amplified in Escherichia coli and isolated using the Pure-Yield™ Maxi Prep Kit (Promega, Madison, Wis.) according to manufacturer instructions.

Murine pancreatic vascular endothelial cells [MS1; ATCC, Manassas, Va.; cultured in Dulbecco's modified Eagle's medium (DMEM) supplemented with 10% fetal bovine serum, penicillin (100 U/mL), and streptomycin (100 µg/mL; Invitrogen)] were transfected with 10 µg of Thy1-pcDNA3.1 ubi/puro-plasmid or with empty control vector (no human Thy1 gene; henceforth control wild-type cells) using Lipofectamine 2000 (Invitrogen) according to manufacturer's instructions.

Flow Cytometry and Immunofluorescence Staining of Murine Vascular Endothelial Cells Flow Cytometry:

One million live cells of both transfected and wild-type cells were washed in phosphate buffered serum (PBS) and incubated with mouse anti-human Thy1 primary antibody (eBioscience; at 1:100) for 30 min at room temperature. This was followed by incubation with anti-mouse PE-antibodies (Jackson ImmunoResearch, 1:200) for 15 min on ice. Expression levels of the Thy1 receptors, on the cell surface of Thy1-expressing and wild-type MS1 cells, were analyzed with a FACSCalibur™ (Becton Dickinson, San Jose, Calif.) and the geometric mean fluorescence intensity was determined using Flow Jo software (Stanford University, Stanford, Calif.).

Immunofluorescence Staining:

To further confirm human Thy1 expression on vascular endothelial MS1 cells, immunofluorescence staining of the cells was performed using standard techniques. In brief, wild-type and Thy-1 expressing cells were grown on cover slips under standard conditions in DMEM complete growth media for 24 hours; after the media was removed, cells were washed in PBS and fixed in 4% paraformaldehyde in PBS solution for 30 min at room temperature. Cells were then washed in PBS, and 1% bovine serum albumin (BSA) blocking solution was applied for one hour. Primary antibody (rabbit anti-human Thy1, Sigma, 1:100) incubation was performed overnight at 4° C. After washing in PBS, secondary antibody (anti-rabbit FITC, Jackson Immunolaboratories, 1:500) was added for one hour at room temperature. Cells were then washed in PBS, counterstained with 4',6-diamidino-2-phenylindole (DAPI), mounted onto glass slides with anti-fade solution and imaged with an Olympus IX81 system.

Preparation of Microbubble Contrast Agents

Perfluorocarbon-filled, lipid-shelled, streptavidin-coated contrast microbubbles (MicroMarker™, VisualSonics, Toronto, Canada) were reconstituted in 1 mL sterile saline (0.9% sodium chloride) according to the manufacturer's protocol. The mean diameter of the microbubbles as assessed by a cell counter and sizer (Multisizer™ III Coulter Counter; Beckman Coulter, Fullerton, Ca) was 1.5±0.1 µm (range, 1-2 µm). Targeted MB were prepared by mixing 6 µg of biotinylated antibodies to $5×10^7$ streptavidin-coated MB for 10 min at room temperature. Two different types of targeted MB were prepared: Microbubbles targeted to human Thy1 ($MB_{Thy1}$) using biotinylated mouse anti-human Thy1 monoclonal antibodies (eBiosciences; San Diego, Calif.); and, control MB ($MB_{Control}$), targeted with an isotype matched control IgG antibody (eBioscience, San Diego, Calif.); non-bound antibodies were removed by washing in PBS.

Flow Chamber Experiments

The three cell types (clone 1 and 2 as well as the wild-type negative control vascular endothelial cells) were grown on neutral-charged glass microscope slides triple-coated with Sigmacote® (Sigma, MO) for 48 hours, then mounted on a parallel plate flow chamber (GlycoTech Corporation, Rockville, Md.). A syringe infusion/withdrawal pump (Genie Plus™, Kent Scientific Corporation, Torrington, Conn.) was used to pass solutions over the cells at a flow rate of 0.6 ml/min, corresponding to a wall shear stress rate of 100 $sec^{-1}$ similar to that in capillaries[2]. Solutions were passed over cells in the following order: 1) PBS for 2 min; 2) $5×10^7$ of either $MB_{Thy1}$ or $MB_{Control}$ in PBS for 4 min; and 3) 2-minute washing with PBS. At least six random fields of view of these slides were immediately imaged with a phase-contrast brightfield microscope (200×; Axiovert 25; Carl Zeiss, Thornwood, N.Y.) to assess the number of MB attached to different cell types (as directly visualized on phase-contrast microscopy). Cell blocking studies to confirm binding specificity of $MB_{Thy1}$ to human Thy1 were performed by pre-incubating Thy1-positive cells with mouse anti-human Thy1 monoclonal antibody (eBiosciences, San Diego, Calif.; 30 µg/ml growth medium) for 30 min at 37° C. All experiments performed under different conditions were performed in triplicates.

Small Animal Ultrasound Molecular Imaging Settings and Protocol

All mice were anesthetized with 2% isoflurane in room air (2 L/min) during scanning.

Ultrasound molecular imaging was performed using a dedicated small animal ultrasound machine (Vevo 2100;

VisualSonics, Toronto, Canada). Images were acquired in a transverse plane with a high-frequency transducer (MS250; center frequency of 21 MHz; lateral and axial resolution of 165 μm and 75 μm, respectively; focal length, 10 mm; transmit power, 4%; mechanical index, 0.2; dynamic range, 40 dB). The acoustic focus was centered at the level of the PDAC xenografts with the imaging plane aligned in the center of the tumor. The same imaging setting was used in all imaging sessions.

Immunofluorescence Staining of Pancreatic Cancer Xenografts

Prior to tumor excision, mice were perfused in vivo with 4% paraformaldehyde at a rate of 4 mL/min for 5 minutes. Mice were then sacrificed and the tumors excised, fixed in 4% paraformaldehyde at 4° C. for 24 hours and transferred into 30% sucrose solution at 4° C. for another 24 hours. Tumors were cryosectioned (slice thickness of 10 μm) and sections were analyzed from the center of the tumor that approximated the corresponding imaging plane from ultrasound imaging. Incubation in 5% normal goat serum in PBS for 30 min was performed to block nonspecific proteins. Sections were simultaneously incubated for 12 hours (4° C.) with 1:100 each of primary antibodies: rabbit anti-human Thy1 antibody (Sigma) and rat anti-mouse CD31 (BD Pharmingen). Secondary antibodies (goat anti-rabbit Alexa™ Fluor 488 antibody and donkey anti-rat Alexa™ Fluor 594 antibody; Invitrogen) were simultaneously applied at 1:600 dilutions in PBS for 30 minutes at room temperature to confirm Thy1 expression on the tumor neovasculature. Fluorescent images were acquired using Metamorph™ software (Universal Imaging Corp., West Chester, Pa.) and a Zeiss Axioscope™ microscope (Axiophot, Carl Weiss AG, Thornwood, N.Y.) attached to a digital camera (AxioCam™ MRc, Bernried, Germany).

REFERENCES

1. Seki T, Spurr N, Obata F, Goyert S, Goodfellow P, Silver J. The human Thy-1 gene: structure and chromosomal location. Proc Natl Acad Sci USA 1985; 82:6657-61.
2. Jain R K. Determinants of tumor blood flow: a review. Cancer Res 1988; 48:2641-58.

Example 2. Additional Pancreatic Cancer-Associated Vascular Endothelial Cell Markers as Imaging Targets of Pancreatic Cancer Associated Angiogenesis We have identified additional high priority candidate markers through our proteomic profiling, as disclosed in Example 1. These candidates include multimerin 1 (MMRN1), mannose receptor type C2 (MRC2), neuropilin (NRP1), and VCAM1.

TABLE 7

Additional Four Vascular Endothelial Cell Marker Candidates for Specific Aim 3.

| Candidates | Location | Endothelial |
|---|---|---|
| MMRN1 (multimerin 1) | Membrane & Extracellular | Y |
| MRC2 (mannose receptor type C2) Also called endo180 | Membrane | Y |
| NRP1 (neuropilin) | Membrane & Extracellular | Y |
| VCAM1 | Membrane | Cytokine-activated endothelium |

SEQUENCE LISTING (131 sequences)

SEQ ID NO: 1 - protein, 161 aa, Homo sapiens
MNLAISIALLLTVLQVSRGQKVTSLTACLVDQSLRLDCRHENTSSSPIQYEFSLTRETKKHVLFGTVGVPEHTYRSRTNFTSKYNMKVLYLSAFTSKDEGTYTCALHHSGHSPPISSQNVTVLRDKLVKCEGISLLAQNTSWLLLLLLSLSLLQATDFMSL

SEQ ID NO: 2 - protein, 1163 aa, Homo sapiens
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 3 - protein, 175 aa, Homo sapiens
RNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGT

SEQ ID NO: 4 - protein, 1140 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDM

SEQ ID NO: 5 - protein, 179 aa, Homo sapiens
DIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQL

SEQ ID NO: 6 - protein, 788 aa, Homo sapiens
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 7 - protein, 243 aa, Homo sapiens
DYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKI

SEQ ID NO: 8 - protein, 835 aa, Homo sapiens
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 9 - protein, 1048 aa, Homo sapiens
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 10 - protein, 537 aa, Homo sapiens
MGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGMNNREVLEQVERGYRMPCPQDCPISLHELMIHCWKKDPEERPTFEYLQSFLEDYFTATEPQYQPGENL

SEQ ID NO: 11 - protein, 509 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQFGEVWMGYYNGHTKVAVKSLKQGSMSPDAFLAEANLMKQLQHQRLVRLYAVVTQEPIYIITEYMENGSLVDFLKTPSGIKLTINKLLDMAAQIAEGMAFIEERNYIHRDLRAANILVSDTLSCKIADFGLARLIEDNEYTAREGAKFPIKWTAPEAINYGTFTIKSDVWSFGILLTEIVTHGRIPYPGMTNPEVIQNLERGYRMVRPDNCPEELYQLMRLCWKERPEDRPTFDYLRSVLEDFFTATEGQYQPQP

SEQ ID NO: 12 - protein, 1152 aa, Homo sapiens
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 13 - protein, 788 aa, Homo sapiens; identical to SEQ ID NO: 6

SEQ ID NO: 14 - protein, 246 aa, Homo sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 15 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 16 - protein, 769 aa, Homo sapiens
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVQLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 17 - protein, 847 aa, Homo sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 18 - protein, 1499 aa, Homo sapiens
MMMARKQDVRIPTYNISVVGLSGTEKEKGQCGIGKSCLCNRFVRPSADEFHLDHTSVLSTSDFGGRVVNNDHFLYWGEVSRSLEDCVECKMHIVEQTEFIDDQTFQPHRSTALQPYIKRAAATKLASAEKLMYFCTDQLGLEQDFEQKQMPDGKLLVDGFLLGIDVSRGMNRNFDDQLKFVSNLYNQLAKTKKPIVVVLTKCDEGVERYIRDAHTFALSKKNLQVVETSARSNVNVDLAFSTLVQLIDKSRGKTKIIPYFEALKQQSQQIATAKDKYEWLVSRIVKNHNENWLSVSRKMQASPEYQDYVYLEGTQKAKKLFLQHIHRLKHEHIERRRKLYLAALPLAFEALIPNLDEIDHLSCIKAKKLLETKPEFLKWFVVLEETPWDATSHIDNMENERIPFDLMDTVPAEQLYEAHLEKLRNERKRVEMRRAFKENLETSPFITPGKPWEEARSFIMNEDFYQWLEESVYMDIYGKHQKQIIDKAKEEFQELLLEYSELFYELELDAKPSKEKMGVIQDVLGEEQRFKALQKLQAERDALILKHIHFVYHPTKETCPSCPACVDAKIEHLISSRFIRPSDRNQKNSLSDPNIDRINLVILGKDGLARELANEIRALCTNDDKYVIDGKMYELSLRPIEGNVRLPVNSFQTPTFQPHGCLCLYNSKESLSYVVESIEKSRESTLGRRDNHLVHLPLTLILVNKRGDTSGETLHSLIQQGQQIASKLQCVFLDPASAGIGYGRNINEKQISQVLKGLLDSKRNLNLVSSTASIKDLADVDLRIVMCLMCGDPFSADDILFPVLQSQTCKSSHCGSNNSVLLELPIGLHKKRIELSVLSYHSSFSIRKSRLVHGYIVFYSAKRKASLAMLRAFLCEVQDIIPIQLVALTDGAVDVLDNDLSREQLTEGEEIAQEIDGRFTSIPCSQPQHKLEIFHPFFKDVVEKKNIIEATHMYDNAAEACSTTEEVFNSPRAGSPLCNSNLQDSEEDIEPSYSLFREDTSLPSLSKDHSKLSMELEGNDGLSFIMSNFESKLNNKVPPPVKPKPPVHFEITKGDLSYLDQGHRDGQRKSVSSSPWLPQDGFDPSDYAEPMDAVVKPRNEEENIYSVPHDSTQGKIITIRNINKAQSNGSGNGSDSEMDTSSLERGRKVSIVSKPVLYRTRCTRLGRFASYRTSFSVGSDDELGPIRKKEEDQASQGYKGDNAVIPYETDEDPRRRNILRSLRRNTKKPKPKPRPSITKATWESNYFGVPLTTVVTPEKPIPIFIERCIEYIEATGLSTEGIYRVSGNKSEMESLQRQFDQDHNLDLAEKDFTVNTVAGAMKSFFSELPDPLVPYNMQIDLVEAHKINDREQKLHALKEVLKKFPKENHEVFKYVISHLNKVSHNNKVNLMTSENLSICFWPTLMRPDFSTMDALTATRTYQTIIELFIQQCPFFFYNRPITEPPGARPSSPSAVASTVPFLTSTPVTSQPSPPQSPPPTPQSPMQPLLPSQLQAEHTL

SEQ ID NO: 19 - protein, 1502 aa, Homo sapiens
MMAKNKEPRPPSYTISIVGLSGTEKDKGNCGVGKSCLCNRFVRSKADEYYPEHTSVLSTIDFGGRVVNNDHFLYWGDIIQNSEDGVECKIHVIEQTEFIDDQTFLPHRSTNLQPYIKRAAASKLQSAEKLMYICTDQLGLEQDFEQKQMPEGKLNVDGFLLCIDVSQGCNRKFDDQLKFVNNLFVQLSKSKKPVIIAATKCDECVDHYLREVQAFASNKKNLLVVETSARFNVNIETCFTALVQMLDKTRSKPKIIPYLDAYKTQRQLVVTATDKFEKLVQTVRDYHATWKTVSNKLKNHPDYEEYINLEGTRKARNTFSKHIEQLKQEHIRKRREEYINTLPRAFNTLLPNLEEIEHLNWSEALKLMEKRADFQLCFVVLEKTPWDETDHIDKINDRRIPFDLLSTLEAEKVYQNHVQHLISEKRRVEMKEKFKKTLEKIQFISPGQPWEEVMCFVMEDEAYKYITEADSKEVYGRHQREIVEKAKEEFQEMLFEHSELFYDLDLNATPSSDKMSEIHTVLSEEPRYKALQKLAPDRESLLLKHIGFVYHPTKETCLSGQNCTDIKVEQLLASSLLQLDHGRLRLYHDSTNIDKVNLFILGKDGLAQELANEIRTQSTDDEYALDGKIYELDLRPVDAKSPYFLSQLWTAAFKPHGCFCVFNSIESLSFIGEFIGKIRTEASQIRKDKYMANLPFTLILANQRDSISKNLPILRHQGQQLANKLQCPFVDVPAGTYPRKFNETQIKQALRGVLESVKHNLDVVSPIPANKDLSEADLRIVMCAMCGDPFSVDLILSPFLDSHSCSAAQAGQNNSLMLDKIIGEKRRRIQITILSYHSSIGVRKDELVHGYILVYSAKRKASMGMLRAFLSEVQDTIPVQLVAVTDSQADFFENEAIKELMTEGEHIATEITAKFTALYSLSQYHRQTEVFTLFFSDVLEKKNMIENSYLSDNTRESTHQSEDVFLPSPRDCFPYNNYPDSDDDTEAPPPYSPIGDDVQLLPTPSDRSRYRLDLEGNEYPIHSTPNCHDHERNHKVPPPIKPKPVVPKTNVKKLDPNLLKTIEAGIGKNPRKQTSRVPLAHPEDMDPSDNYAEPIDTIFKQKGYSDEIYVVPDDSQNRIKIRNSFVNNTQGDEENGFSDRTSKSHGERRPSKYKYKSKTLFSKAKSYYRRTHSDASDDEAFTTSKTKRKGRHRGSEEDPLLSPVETWKGGIDNPAITSDQELDDKKMKKKTHKVKEDKKQKKKTKNFNPPTRRNWESNYFGMPLQDLVTAEKPIPLFVEKCVEFIEDTGLCTEGLYRVSGNKTDQDNIQKQFDQDHNINLVSMEVTVNAVAGALKAFFADLPDPLIPYSLHPELLEAAKIPDKTERLHALKEIVKKFHPVNYDVFRYVITHLNRVSQQHKINLMTADNLSICFWPTLMRPDFENREFLSTTKIHQSVVETFIQQCQFFFYNGEIVETTNIVAPPPPSNPGQLVEPMVPLQLPPPLQPQLIQPQLQTDPLGII

SEQ ID NO: 20 - protein, 689 aa, Homo sapiens
MKPVHERSQECLPPKKRDLPVTSEDMGRTTSCSTNHTPSSDASEWSRGVVVAGQSQAGARVSLGGDGAEAITGLTVDQYGMLYKVAVPPATFSPTGLPSVVNMSPLPPTFNVASSLIQHPGIHYPPLHYAQLPSTSLQFIGSPYSLPYAVPPNFLPSPLLSPSANLATSHLPHFVPYASLLAEGATPPPQAPSPAHSFNKAPSATSPSGQLPHHSSTQPLDLAPGRMPIYYQMSRLPAGYTLHETPPAGASPVLTPQESQSALEAAAANGGQRPRERNLVRRESEALDSPNSKGEGQGLVPVVECVVDGQLFSGSQTPRVEVAAPAHRGTPDTDLEVQRVVGALASQDYRVVAAQRKEEPSPLNLSHHTPDHQGEGRGSARNPAELAEKSQARGFYPQSHQEPVKHRPLPKAMVVANGNLVPTGTDSGLLPVGSEILVASSLDVQARATFPDKEPTPPPITSSHLPSHFMKGAIIQLATGELKRVEDLQTQDFVRSAEVSGGLKIDSSTVVDIQESQWPGFVMLHFVVGEQQSKVSIEVPPEHPFFVYGQGWSSCSPGRTTQLFSLPCHRLQVGDVCISISLQSLNSNSVSQASCAPPSQLGPPRERPERTVLGSRELCDSEGKSQPAGEGSRVVEPSQPESGAQACWPAPSFQRYSMQGEEARAALLRPSFIPQEVKLSIEGRSNAGK

SEQ ID NO: 21 - protein, 1228 aa, Homo sapiens
MKGARLFVLLSSLWSGGIGLNNSKHSWTIPEDGNSQKTMPSASVPPNKIQSLQILPTTRVMSAEIATTPEARTSEDSLLKSTLPPSETSAPAEGVRNQTLTSTEKAEGVVKLQNLTLPTNASIKFNPGAESVVLSNSTLKFLQSFARKSNEQATSLNTVGGTGGIGGVGGTGGVGNRAPRETYLSRGDSSSSQRTDYQKSNFETTRGKNWCAYVHTRLSPTVILDNQVTYVPGGKGPCGWTGGSCPQRSQKISNPVYRMQHKIVTSLDWRCCPGYSGPKCQLRAQEQQSLIHTNQAESHTAVGRGVAEQQQQQGCGDPEVMQKMTDQVNYQAMKLTLLQKKIDNISLTVNDVRNTYSSLEGKVSEDKSREFQSLLKGLKSKSINVLIRDIVREQFKIFQNDMQETVAQLFKTVSSLSEDLESTRQIIQKVNESVVSIAAQQKFVLVQENRPTLTDIVELRNHIVNVRQEMTLTCEKPIKELEVKQTHLEGALEQEHSRSILYYESLNKTLSKLKEVHEQLLSTEQVSDQKNAPAAESVSNNVTEYMSTLHENIKKQSLMMLQMFEDLHIQESKINNLTVSLEMEKESLRGECEDMLSKCRNDFKFQLKDTEENLHVLNQTLAEVLFPMDNKMDKMSEQLNDLTYDMEILQPLLEQGASLRQTMTYEQPKEAIVIRKKIENLTSAVNSLNFIIKELTKRHNLLRNEVQGRDDALERRINEYALEMEDGLNKTMTIINNAIDFIQDNYALKETLSTIKDNSEIHHKCTSDMETILTFIPQFHRLNDSIQTLVNDNQRYNFVLQVAKTLAGIPRDEKLNQSNFQKMYQMFNETTSQVRKYQQNMSHLEEKLLLTTKISKNFETRLQDIESKVTQTLIPYYISVKKGSVVTNERDQALQLQVLNSRFKALEAKSIHLSINFFSLNKTLHEVLTMCHNASTSVSELNATIPKWIKHSLPDIQLLQKGLTEFVEPIIQIKTQAALSNLTCCIDRSLPGSLANVVKSQKQVKSLPKKINALKKPTVNLTTVLIGRTQRNTDNIIYPEEYSSCSRHPCQNGGTCINGRTSFTCACRHPFTGDNCTIKLVEENALAPDFSKGSYRYAPMVAFFASHTYGMTIPGPILFNNLDVNYGASYTPRTGKFRIPYLGVYVFKYTIESFSAHISGFLVVDGIDKLAFESENINSEIHCDRVLTGDALLELNYGQEVWLRLAKGTIPAKFPPVTTFSGYLLYRT

SEQ ID NO: 22 - protein, 2224 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPMDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 23 - protein, 2843 aa, Homo sapiens
MAAASYDQLLKQVEALKMENSNLRQELEDNSNHLTKLETEASNMKEVLKQLQGSIEDEAMASSGQIDLLERLKELNLDSSNFPGVKLRSKMSLRSYGSREGSVSSRSGECSPVPMGSFPRRGFVNGSRESTGYLEELEKERSLLLADLDKEEKEKDWYYAQLQNLTKRIDSLPLTENFSLQTDMTRRQLEYEARQIRVAMEEQLGTCQDMEKRAQRRIARIQQIEKDILRIRQLLQSQATEAERSSQNKHETGSHDAERQNEGQGVGEINMATSGNGQGSTTRMDHETASVLSSSSTHSAPRRLTSHLGTKVEMVYSLLSMLGTHDKDDMSRTLLAMSSSQDSCISMRQSGCLPLLIQLLHGNDKDSVLLGNSRGSKEARARASAALHNIIHSQPDDKRGRREIRVLHLLEQIRAYCETCWEWQEAHEPGMDQDKNPMPAPVEHQICPAVCVLMKLSFDEEHRHAMNELGGLQAIAELLQVDCEMYGLTNDHYSITLRRYAGMALTNLTFGDVANKATLCSMKGCMRALVAQLKSESEDLQQVIASVLRNLSWRADVNSKKTLREVGSVKALMECALEVKKESTLKSVLSALWNLSAHCTENKADICAVDGALAFLVGTLTYRSQTNTLAIIESGGGILRNVSSLIATNEDHRQILRENNCLQTLLQHLKSHSLTIVSNACGTLWNLSARNPKDQEALWDMGAVSMLKNLIHSKHKMIAMGSAAALRNLMANRPAKYKDANIMSPGSSLPSLHVRKQKALEAELDAQHLSETFDNIDNLSPKASHRSKQRHKQSLYGDYVFDTNRHDDNRSDNFNTGNMTVLSPYLNTTVLPSSSSSRGSLDSSRSEKDRSLERERGIGLGNYHPATENPGTSSKRGLQISTTAAQIAKVMEEVSAIHTSQEDRSSGSTTELHCVTDERNALRRSSAAHTHSNTYNFTKSENSNRTCSMPYAKLEYKRSSNDSLNSVSSSDGYGKRGQMKPSIESYSEDDESKFCSYGQYPADLAHKIHSANHMDDNDGELDTPINYSLKYSDEQLNSGRQSPSQNERWARPKHIIEDEIKQSEQRQSRNQSTTYPVYTESTDDKHLKFQPHFGQQECVSPYRSRGANGSETNRVGSNHGINQNVSQSLCQEDDYEDDKPTNYSERYSEEEQHEEEERPTNYSIKYNEEKRHVDQPIDYSLKYATDIPSSQKQSFSFSKSSSGQSSKTEHMSSSSENTSTPSSNAKRQNQLHPSSAQSRSGQPQKAATCKVSSINQETIQTYCVEDTPICFSRCSSLSSLSSAEDEIGCNQTTQEADSANTLQIAEIKEKIGTRSAEDPVSEVPAVSQHPRTKSSRLQGSSLSSESARHKAVEFSSGAKSPSKSGAQTPKSPPEHYVQETPLMFSRCTSVSSLDSFESRSIASSVQSEPCSGMVSGIISPSDLPDSPGQTMPPSRSKTPPPPPQTAQTKREVPKNKAPTAEKRESGPKQAAVNAAVQRVQVLPDADTLLHFATESTPDGFSCSSSLSALSLDEPFIQKDVELRIMPPVQENDNGNETESEQPKESNENQEKEAEKTIDSEKDLLDDSDDDDIEILEECIISAMPTKSSRKAKKPAQTASKLPPPVARKPSQLPVYKLLPSQNRLQPQKHVSFTPGDDMPRVYCVEGTPINFSTATSLSDLTIESPPNELAAGEGVRGGAQSGEFEKRDTIPTEGRSTDEAQGGKTSSVTIPELDDNKAEEGDILAECINSAMPKGKSHKPFRVKKIMDQVQQASASSSAPNKNQLDGKKKKPTSPVKPIPQNTEYRTRVRKNADSKNNLNAERVFSDNKDSKKQNLKNNSKVFNDKLPNNEDRVRGSFAFDSPHHYTPIEGTPYCFSRNDSLSSLDFDDDDVDLSREKAELRKAKENKESEAKVTSHTELTSNQQSANKTQAIAKQPINRGQPKPILQKQSTFPQSSKDIPDRGAATDEKLQNFAIENTPVCFSHNSSLSSLSDIDQENNNKENEPIKETEPPDSQGEPSKPQASGYAPKSFHVEDTPVCFSRNSSLSSLSIDSEDDLLQECISSAMPKKKKPSRLKGDNEKHSPRNMGGILGEDLTLDLKDIQRPDSEHGLSPDSENFDWKAIQEGANSIVSSLHQAAAAACLSRQASSDSDSILSLKSGISLGSPFHLTPDQEEKPFTSNKGPRILKPGEKSTLETKKIESESKGIKGGKKVYKSLITGKVRSNSEISGQMKQPLQANMPSISRGRTMIHIPGVRNSSSSTSPVSKKGPPLKTPASKSPSEGQTATTSPRGAKPSVKSELSPVARQTSQIGGSSKAPSRSGSRDSTPSRPAQQPLSRPIQSPGRNSISPGRNGISPPNKLSQLPRTSSPSTASTKSSGSGKMSYTSPGRQMSQQNLTKQTGLSKNASSIPRSESASKGLNQMNNGNGANKKVELSRMSSTKSSGSESDRSERPVLVRQSTFIKEAPSPTLRRKLEESASFESLSPSSRPASPTRSQAQTPVLSPSLPDMSLSTHSSVQAGGWRKLPPNLSPTIEYNDGRPAKRHDIARSHSESPSRLPINRSGTWKREHSKHSSSLPRVSTWRRTGSSSSILSASSESSEKAKSEDEKHVNSISGTKQSKENQVSAKGTWRKIKENEFSPTNSTSQTVSSGATNGAESKTLIYQMAPAVSKTEDVWVRIEDCPINNPRSGRSPTGNTPPVIDSVSEKANPNIKDSKDNQAKQNVGNGSVPMRTVGLENRLNSFIQVDAPDQKGTEIKPGQNNPVPVSETNESSIVERTPFSSSSSSKHSSPSGTVAARVTPFNYNPSPRKSSADSTSARPSQIPTPVNNNTKKRDSKTDSTESSGTQSPKRHSGSYLVTSV

SEQ ID NO: 24 - protein, 609 aa, Homo sapiens [sequence omitted]

SEQ ID NO: 25 - protein, 770 aa, Homo sapiens; identical to SEQ ID NO: 15

SEQ ID NO: 26 - protein, 1207 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 27 - protein, 2351 aa, Homo sapiens
MQIELSTCFFLCLLRFCFSATRRYYLGAVELSWDYMQSDLGELPVDARFPPRVPKSFPFNTSVVYKKTLFVEFTDHLFNIAKPRPPWMGLLGPTIQAEVYDTVVITLKNMASHPVSLHAVGVSYWKASEGAEYDDQTSQREKEDDKVFPGGSHTYVWQVLKENGPMASDPLCLTYSYLSHVDLVKDLNSGLIGALLVCREGSLAKEKTQTLHKFILLFAVFDEGKSWHSETKNSLMQDRDAASARAWPKMHTVNGYVNRSLPGLIGCHRKSVYWHVIGMGTTPEVHSIFLEGHTFLVRNHRQASLEISPITFLTAQTLLMDLGQFLLFCHISSHQHDGMEAYVKVDSCPEEPQLRMKNNEEAEDYDDDLTDSEMDVVRFDDDNSPSFIQIRSVAKKHPKTWVHYIAAEEEDWDYAPLVLAPDDRSYKSQYLNNGPQRIGRKYKKVRFMAYTDETFKTREAIQHESGILGPLLYGEVGDTLLIIFKNQASRPYNIYPHGITDVRPLYSRRLPKGVKHLKDFPILPGEIFKYKWTVTVEDGPTKSDPRCLTRYYSSFVNMERDLASGLIGPLLICYKESVDQRGNQIMSDKRNVILFSVFDENRSWYLTENIQRFLPNPAGVQLEDPEFQASNIMHSINGYVFDSLQLSVCLHEVAYWYILSIGAQTDFLSVFFSGYTFKHKMVYEDTLTLFPFSGETVFMSMENPGLWILGCHNSDFRNRGMTALLKVSSCDKNTGDYYEDSYEDISAYLLSKNNAIEPRSFSQNSRHPSTRQKQFNATTIPENDIEKTDPWFAHRTPMPKIQNVSSSDLLMLLRQSPTPHGLSLSDLQEAKYETFSDDPSPGAIDSNNSLSEMTHFRPQLHHSGDMVFTPESGLQLRLNEKLGTTAATELKKLDFKVSSTSNNLISTIPSDNLAAGTDNTSSLGPPSMPVHYDSQLDTTLFGKKSSPLTESGGPLSLSEENNDSKLLESGLMNSQESSWGKNVSSTESGRLFKGKRAHGPALLTKDNALFKVSISLLKTNKTSNNSATNRKTHIDGPSLLIENSPSVWQNILESDTEFKKVTPLIHDRMLMDKNATALRLNHMSNKTTSSKNMEMVQQKKEGPIPPDAQNPDMSFFKMLFLPESARWIQRTHGKNSLNSGQGPSPKQLVSLGPEKSVEGQNFLSEKNKVVVGKGEFTKDVGLKEMVFPSSRNLFLTNLDNLHENNTHNQEKKIQEEIEKKETLIQENVVLPQIHTVTGTKNFMKNLFLLSTRQNVEGSYDGAYAPVLQDFRSLNDSTNRTKKHTAHFSKKGEEENLEGLGNQTKQIVEKYACTTRISPNTSQQNFVTQRSKRALKQFRLPLEETELEKRIIVDDTSTQWSKNMKHLTPSTLTQIDYNEKEKGAITQSPLSDCLTRSHSIPQANRSPLPIAKVSSFPSIRPIYLTRVLFQDNSSHLPAASYRKKDSGVQESSHFLQGAKKNNLSLAILTLEMTGDQREVGSLGTSATNSVTYKKVENTVLPKPDLPKTSGKVELLPKVHIYQKDLFPTETSNGSPGHLDLVEGSLLQGTEGAIKWNEANRPGKVPFLRVATESSAKTPSKLLDPLAWDNHYGTQIPKEEWKSQEKSPEKTAFKKKDTILSLNACESNHAIAAINEGQNKPEIEVTWAKQGRTERLCSQNPPVLKRHQREITRTTLQSDQEEIDYDDTISVEMKKEDFDIYDEDENQSPRSFQKKTRHYFIAAVERLWDYGMSSSPHVLRNRAQSGSVPQFKKVVFQEFTDGSFTQPLYRGELNEHLGLLGPYIRAEVEDNIMVTFRNQASRPYSFYSSLISYEEDQRQGAEPRKNFVKPNETKTYFWKVQHHMAPTKDEFDCKAWAYFSDVDLEKDVHSGLIGPLLVCHTNTLNPAHGRQVTVQEFALFFTIFDETKSWYFTENMERNCRAPCNIQMEDPTFKENYRFHAINGYIMDTLPGLVMAQDQRIRWYLLSMGSNENIHSIHFSGHVFTVRKKEEYKMALYNLYPGVFETVEMLPSKAGIWRVECLIGEHLHAGMSTLFLVYSNKCQTPLGMASGHIRDFQITASGQYGQWAPKLARLHYSGSINAWSTKEPFSWIKVDLLAPMIIHGIKTQGARQKFSSLYISQFIIMYSLDGKKWQTYRGNSTGTLMVFFGNVDSSGIKHNIFNPPIIARYIRLHPTHYSIRSTLRMELMGCDLNSCSMPLGMESKAISDAQITASSYFTNMFATWSPSKARLHLQGRSNAWRPQVNNPKEWLQVDFQKTMKVTGVTTQGVKSLLTSMYVKEFLISSSQDGHQWTLFFQNGKVKVFQGNQDSFTPVVNSLDPPLLTRYLRIHPQSWVHQIALRMEVLGCEAQDLY

SEQ ID NO: 28 - protein, 2477 aa, Homo sapiens
MLRGPGPGLLLLAVQCLGTAVPSTGASKSKRQAQQMVQPQSPVAVSQSKPGCYDNGKHYQINQQWERTYLGNALVCTCYGGSRGFNCESKPEAEETCFDKYTGNTYRVGDTYERPKDSMIWDCTCIGAGRGRISCTIANRCHEGGQSYKIGDTWRRPHETGGYMLECVCLGNGKGEWTCKPIAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVDQCQDSETGTFYQIGDSWEKYVHGVRYQCYCYGRGIGEWHCQPLQTYPSSSGPVEVFITETPSQPNSHPIQWNAPQPSHISKYILRWRPKNSVGRWKEATIPGHLNSYTIKGLKPGVVYEGQLISIQQYGHQEVTRFDFTTTSTSTPVTSNTVTGETTPFSPLVATSESVTEITASSFVVSWVSASDTVSGFRVEYELSEEGDEPQYLDLPSTATSVNIPDLLPGRKYIVNVYQISEDGEQSLILSTSQTTAPDAPPDTTVDQVDDTSIVVRWSRPQAPITGYRIVYSPSVEGSSTELNLPETANSVTLSDLQPGVQYNITIYAVEENQESTPVVIQQETTGTPRSDTVPSPRDLQFVEVTDVKVTIMWTPPESAVTGYRVDVIPVNLPGEHGQRLPISRNTFAEVTGLSPGVTYYFKVFAVSHGRESKPLTAQQTTKLDAPTNLQFVNETDSTVLVRWTPPRAQITGYRLTVGLTRRGQPRQYNVGPSVSKYPLRNLQPASEYTVSLVAIKGNQESPKATGVFTTLQPGSSIPPYNTEVTETTIVITWTPAPRIGFKLGVRPSQGGEAPREVTSDSGSIVVSGLTPGVEYVYTIQVLRDGQERDAPIVNKVVTPLSPPTNLHLEANPDTGVLTVSWERSTTPDITGYRITTTPTNGQQGNSLEEVVHADQSSCTFDNLSPGLEYNVSVYTVKDDKESVPISDTIIPEVPQLTDLSFVDITDSSIGLRWTPLNSSTIIGYRITVVAAGEGIPIFEDFVDSSVGYYTVTGLEPGIDYDISVITLINGGESAPTTLTQQTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTDELPQLVTLPHPNLHGPEILDVPSTVQKTPFVTHPGYDTGNGIQLPGTSGQQPSVGQQMIFEEHGFRRTTPPTTATPIRHRPRPYPPNVGEEIQIGHIPREDVDYHLYPHGPGLNPNASTGQEALSQTTISWAPFQDTSEYIISCHPVGTDEEPLQFRVPGTSTSATLTGLTRGATYNVIVEALKDQQRHKVREEVVTVGNSVNEGLNQPTDDSCFDPYTVSHYAVGDEWERMSESGFKLLCQCLGFGSGHFRCDSSRWCHDNGVNYKIGEKWDRQGENGQMMSCTCLGNGKGEFKCDPHEATCYDDGKTYHVGEQWQKEYLGAICSCTCFGGQRGWRCDNCRRPGGEPSPEGTTGQSYNQYSQRYHQRTNTNVNCPIECFMPLDVQADREDSRE

SEQ ID NO: 29 - protein, 644 aa, Homo sapiens
MKLITILFLCSRLLLSLTQESQSEEIDCNDKDLFKAVDAALKKYNSQNQSNNQFVLYRITEATKTVGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFMLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPIQSDDDWIPDIQIDPNGLSFNPISDFPDTTSPKCPGRPWKSVSEINPTTQMKESYYFDLTDGLS

SEQ ID NO: 30 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 31 - protein, 810 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 32 - protein, 128 aa, Homo sapiens
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 33 - protein, 402 aa, Homo sapiens [sequence omitted]

SEQ ID NO: 34 - protein, 303 aa, Homo sapiens
MRAWIFFLLCLAGRALAAPQQEALPDETEVVEETVAEVTEVSVGANPVQVEVGEFDDGAEETEEEVVAENPCQNHHCKHGKVCELDENNTPMCVCQDPTSCPAPIGEFEKVCSNDNKTFDSSCHFFATKCTLEGTKKGHKLHLDYIGPCKYIPPCLDSELTEFPLRMRDWLKNVLVTLYERDEDNNLLTEKQKLRVKKIHENEKRLEAGDHPVELLARDFEKNYNMYIFPVHWQFGQLDQHPIDGYLSHTELAPLRAPLIPMEHCTTRFFETCDLDNDKYIALDEWAGCFGIKQKDIDKDLVI

SEQ ID NO: 35 - protein, 158 aa, Homo sapiens
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 36 - protein, 390 aa, Homo sapiens
MPPSGLRLLPLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 37 - protein, 412 aa, Homo sapiens
MKMHLQRALVVLALLNFATVSLSLSTCTTLDFGHIKKKRVEAIRGQILSKLRLTSPPEPTVMTHVPYQVLALYNSTRELLEEMHGEREEGCTQENTESEYYAKEIHKFDMIQGLAEHNELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKGVDNEDDHGRGDLGRLKKQKDHHNPHLILMMIPPHRLDNPGQGGQRKKRALDTNYCFRNLEENCCVRPLYIDFRQDLGWKWVHEPKGYYANFCSGPCPYLRSADTTHSTVLGLYNTLNPEASASPCCVPQDLEPLTILYYVGRTPKVEQLSNMVVKSCKCS

SEQ ID NO: 38 - protein, 1474 aa, Homo sapiens
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDNEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEIKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 39 - protein, 914 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKAETAANRICKVLAVNQENEQLMEDYEKLASDLLEWIRRTIPWLENRVPENTMHAMQQKLEDFRDYRRLHKPPKVQEKCQLEINFNTLQTKLRLSNRPAFMPSEGRMVSDINNAWGCLEQVEKGYEEWLLNEIRRLERLDHLAEKFRQKASIHEAWTDGKEAMLRQKDYETATLSEIKALLKKHEAFESDLAAHQDRVEQIAAIAQELNELDYYDSPSVNARCQKICDQWDNLGALTQKRREALERTEKLLETIDQLYLEYAKRAAPFNNWMEGAMEDLQDTFIVHTIEEIQGLTTAHEQFKATLPDADKERLAILGIHNEVSKIVQTYHVNMAGTNPYTTITPQEINGKWDHVRQLVPRRDQALTEEHARQQHNERLRKQFGAQANVIGPWIQTKMEEIGRISIEMHGTLEDQLSHLRQYEKSIVNYKPKIDQLEGDHQLIQEALIFDNKHTNYTMEHIRVGWEQLLTTIARTINEVENQILTRDAKGISQEQMNEFRASFNHFDRDHSGTLGPEEFKACLISLGYDIGNDPQKKTGMMDTDDFRACLISMGYNMGEAEFARIMSIVDPNRLGVVTFQAFIDFMSRETADTDTADQVMASFKILAGDKNYITMDELRRELPPDQAEYCIARMAPYTGPDSVPGALDYMSFSTALYGESDL

SEQ ID NO: 40 - protein, 894 aa, Homo sapiens
MNQIEPGVQYNYVYDEDEYMIQEEEWDRDLLLDPAWEKQQRKTFTAWCNSHLRKAGTQIENIEEDFRNGLKLMLLLEVISGERLPKPDRGKMRFHKIANVNKALDYIASKGVKLVSIGAEEIVDGNVKMTLGMIWTIILRFAIQDISVEETSAKEGLLLWCQRKTAPYRNVNIQNFHTSWKDGLGLCALIHRHRPDLIDYSKLNKDDPIGNINLAMEIAEKHLDIPKMLDAEDIVNTPKPDERAIMTYVSCFYHAFAGAEQAETAANRICKVLAVNQENERLMEEYERLASELLEWIRRTIPWLENRTPEKTMQAMQKKLEDFRDYRRKHKPPKVQEKCQLEINFNTLQTKLRISNRPAFMPSEGKMVSDIAGAWQRLEQAEKGYEEWLLNEIRRLERLEHLAEKFRQKASTHETWAYGKEQILLQKDYESASLTEVRALLRKHEAFESDLAAHQDRVEQIAAIAQELNELDYHDAVNVNDRCQKICDQWDRLGTLTQKRREALERMEKLLETIDQLHLEFAKRAAPFNNWMEGAMEDLQDMFIVHSIEEIQSLITAHEQFKATLPEADGERQSIMAIQNEVEKVIQSYNIRISSSNPYSTVTMDELRTKWDKVKQLVPIRDQSLQEELARQHANERLRRQFAAQANAIGPWIQNKMEEIARSSIQITGALEDQMNQLKQYEHNIINYKNNIDKLEGDHQLIQEALVFDNKHTNYTMEHIRVGWELLLTTIARTINEVETQILTRDAKGITQEQMNEFRASFNHFDRRKNGLMDHEDFRACLISMGYDLGEAEFARIMTLVDPNGQGTVTFQSFIDFMTRETADTDTAEQVIASFRILASDKPYILAEELRRELPPDQAQYCIKRMPAYSGPGSVPGALDYAAFSSALYGESDL

SEQ ID NO: 41 - protein, 911 aa, Homo sapiens
MVDYHAANQSYQYGPSSAGNGAGGGGSMGDYMAQEDDWDRDLLLDPAWEKQQRKTFTAWCNSHLRKAGTQIENIDEDFRDGLKLMLLLEVISGERLPKPERGKMRVHKINNVNKALDFIASKGVKLVSIGAEEIVDGNAKMTLGMIWTIILRFAIQDISVEETSAKEGLLLWCQRKTAPYKNVNVQNFHISWKDGLAFNALIHRHRPELIEYDKLRKDDPVTNLNNAFEVAEKYLDIPKMLDAEDIVNTARPDEKAIMTYVSSFYHAFSGAQKAETAANRICKVLAVNQENEHLMEDYEKLASDLLEWIRRTIPWLEDRVPQKTIQEMQQKLEDFRDYRRVHKPPKVQEKCQLEINFNTLQTKLRLSNRPAFMPSEGKMVSDINNGWQHLEQAEKGYEEWLLNEIRRLERLDHLAEKFRQKASIHEAWTDGKEAMLKHRDYETATLSDIKALIRKHEAFESDLAAHQDRVEQIAAIAQELNELDYYDSHNVNTRCQKICDQWDALGSLTHSRREALEKTEKQLEAIDQLHLEYAKRAAPFNNWMESAMEDLQDMFIVHTIEEIEGLISAHDQFKSTLPDADREREAILAIHKEAQRIAESNHIKLSGSNPYTTVTPQIINSKWEKVQQLVPKRDHALLEEQSKQQSNEHLRRQFASQANVVGPWIQTKMEEIGRISIEMNGTLEDQLSHLKQYERSIVDYKPNLDLLEQQHQLIQEALIFDNKHTNYTMEHIRVGWEQLLTTIARTINEVENQILTRDAKGISQEQMQEFRASFNHFDKDHGGALGPEEFKACLISLGYDVENDRQGEAEFNRIMSLVDPNHSGLVTFQAFIDFMSRETTDTDTADQVIASFKVLAGDKNFITAEELRRELPPDQAEYCIARMAPYQGPDAVPGALDYKSFSTALYGESDL

SEQ ID NO: 42 - protein, 364 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 43 - protein, 253 aa, Homo sapiens
MHSWERLAVLVLLGAAACAAPPRGRILGGREAEAHARPYMASVQLNGAHLCGGVLVAEQWVLSAAHCLEDAADGKVQVLLGAHSLSQPEPSKRLYDVLRAVPHPDSQPDTIDHDLLLLQLSEKATLGPAVRPLPWQRVDRDVAPGTLCDVAGWGIVNHAGRRPDSLQHVLLPVLDRATCNRRTHHDGAITERLMCAESNRRDSCKGDSGGPLVCGGVLEGVVTSGSRVCGNRKKPGIYTRVASYAAWIDSVLA

SEQ ID NO: 44 - protein, 449 aa, Homo sapiens
MMKTLLLFVGLLLTWESGQVLGDQTVSDNELQEMSNQGSKYVNKEIQNAVNGVKQIKTLIEKTNEERKTLLSNLEEAKKKKEDALNETRESETKLKELPGVCNETMMALWEECKPCLKQTCMKFYARVCRSGSGLVGRQLEEFLNQSSPFYFWMNGDRIDSLLENDRQQTHMLDVMQDHFSRASSIIDELFQDRFFTREPQDTYHYLPFSLPHRRPHFFFPKSRIVRSLMPFSPYEPLNFHAMFQPFLEMIHEAQQAMDIHFHSPAFQHPPTEFIREGDDDRTVCREIRHNSTGCLRMKDQCDKCREILSVDCSTNNPSQAKLRRELDESLQVAERLTRKYNELLKSYQWKMLNTSSLLEQLNEQFNWVSRLANLTQGEDQYYLRVTTVASHTSDSDVPSGVTEVVVKLFDSDPITVTVPVEVSRKNPKFMETVAEKALQEYRKKHREE

SEQ ID NO: 45 - protein, 732 aa, Homo sapiens
MSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVEFTNPLKETLRNVWVHLDGPGVTRPMKKMFREIRPNSTVQWEEVCRPWVSGHRKLIASMSSDSLRHVYGELDVQIQRRPSM

SEQ ID NO: 46 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 47 - protein, 678 aa, Homo sapiens
MAPSLSPGPAALRRAPQLLLLLLAAECALAALLPAREATQFLRPRQRRAFQVFEEAKQGHLERECVEELCSREEAREVFENDPETDYFYPRYLDCINKYGSPYTKNSGFATCVQNLPDQCTPNPCDRKGTQACQDLMGNFFCLCKAGWGGRLCDKDVNECSQENGGCLQICHNKPGSFHCSCHSGFELSSDGRTCQDIDECADSEACGEARCKNLPGSYSCLCDEGFAYSSQEKACRDVDECLQGRCEQVCVNSPGSYTCHCDGRGGLKLSQDMDTCEDILPCVPFSVAKSVKSLYLGRMFSGTPVIRLRFKRLQPTRLVAEFDFRTFDPEGILLFAGGHQDSTWIVLALRAGRLELQLRYNGVGRVTSSGPVINHGMWQTISVEELARNLVIKVNRDAVMKIAVAGDLFQPERGLYHLNLTVGGIPFHEKDLVQPINPRLDGCMRSWNWLNGEDTTIQETVKVNTRMQCFSVTERGSFYPGSGFAFYSLDYMRTPLDVGTESTWEVEVVAHIRPAADTGVLFALWAPDLRAVPLSVALVDYHSTKKLKKQLVVLAVEHTALALMEIKVCDGQEHVVTVSLRDGEATLEVDGTRGQSEVSAAQLQERLAVLERHLRSPVLTFAGGLPDVPVTSAPVTAFYRGCMTLEVNRRLLDLDEAAYKHSDITAHSCPPVEPAAA

SEQ ID NO: 48 - protein, 418 aa, Homo sapiens
MPSSVSWGILLLAGLCCLVPVSLAEDPQGDAAQKTDTSHHDQDHPTFNKITPNLAEFAFSLYRQLAHQSNSTNIFFSPVSIATAFAMLSLGTKADTHDEILEGLNFNLTEIPEAQIHEGFQELLRTLNQPDSQLQLTTGNGLFLSEGLKLVDKFLEDVKKLYHSEAFTVNFGDTEEAKKQINDYVEKGTQGKIVDLVKELDRDTVFALVNYIFFKGKWERPFEVKDTEEEDFHVDQVTTVKVPMMKRLGMFNIQHCKKLSSWVLLMKYLGNATAIFFLPDEGKLQHLENELTHDIITKFLENEDRRSASLHLPKLSITGTYDLKSVLGQLGITKVFSNGADLSGVTEEAPLKLSKAVHKAVLTIDEKGTEAAGAMFLEAIPMSIPPEVKFNKPFVFLMIEQNTKSPLFMGKVVNPTQK

SEQ ID NO: 49 - protein, 491 aa, Homo sapiens
MALLWGLLVLSWSCLQGPCSVFSPVSAMEPLGRQLTSGPNQEQVSPLTLLKLGNQEPGGQTALKSPPGVCSRDPTPEQTHRLARAMMAFTADLFSLVAQTSTCPNLILSPLSVALALSHLALGAQNHTLQRLQQVLHAGSGPCLPHLLSRLCQDLGPGAFRLAARMYLQKGFPIKEDFLEQSEQLFGAKPVSLTGKQEDDLANINQWVKEATEGKIQEFLSGLPEDTVLLLLNAIHFQGFWRNKFDPSLTQRDSFHLDEQFTVPVEMMQARTYPLRWFLLEQPEIQVAHFPFKNNMSFVVLVPTHFEWNVSQVLANLSWDTLHPPLVWERPTKVRLPKLYLKHQMDLVATLSQLGLQELFQAPDLRGISEQSLVVSGVQHQSTLELSEVGVEAAAATSIAMSRMSLSSFSVNRPFLFFIFEDTTGLPLFVGSVRNPNPSAPRELKEQQDSPGNKDFLQSLKGFPRGDKLFGPDLKLVPPMEEDYPQFGSPK

SEQ ID NO: 50 - protein, 500 aa, Homo sapiens
MASRLTLLTLLLLLLAGDRASSNPNATSSSSQDPESLQDRGEGKVATTVISKMLFVEPILEVSSLPTTNSTTNSATKITANTTDEPTTQPTTEPTTQPTIQPTQPTTQLPTDSPTQPTTGSFCPGPVTLCSDLESHSTEAVLGDALVDFSLKLYHAFSAMKKVETNMAFSPFSIASLLTQVLLGAGENTKTNLESILSYPKDFTCVHQALKGFTTKGVTSVSQIFHSPDLAIRDTFVNASRTLYSSSPRVLSNNSDANLELINTWVAKNTNNKISRLLDSLPSDTRLVLLNAIYLSAKWKTTFDPKKTRMEPFHFKNSVIKVPMMNSKKYPVAHFIDQTLKAKVGQLQLSHNLSLVILVPQNLKHRLEDMEQALSPSVFKAIMEKLEMSKFQPTLLTLPRIKVTTSQDMLSIMEKLEFFDFSYDLNLCGLTEDPDLQVSAMQHQTVLELTETGVEAAAASAISVARTLLVFEVQQPFLFVLWDQQHKFPVFMGRVYDPRA

SEQ ID NO: 51 - protein, 442 aa, Homo sapiens
MHYCVLSAFLILHLVTVALSLSTCSTLDMDQFMRKRIEAIRGQILSKLKLTSPPEDYPEPEEVPPEVISIYNSTRDLLQEKASRRAAACERERSDEEYYAKEVYKIDMPPFFPSETVCPVVTTPSGSVGSLCSRQSQVLCGYLDAIPPTFYRPYFRIVRFDVSAMEKNASNLVKAEFRVFRLQNPKARVPEQRIELYQILKSKDLTSPTQRYIDSKVVKTRAEGEWLSFDVTDAVHEWLHHKDRNLGFKISLHCPCCTFVPSNNYIIPNKSEELEARFAGIDGTSTYTSGDQKTIKSTRKKNSGKTPHLLLMLLPSYRLESQQTNRRKKRALDAAYCFRNVQDNCCLRPLYIDFKRDLGWKWIHEPKGYNANFCAGACPYLWSSDTQHSRVLSLYNTINPEASASPCCVSQDLEPLTILYYIGKTPKIEQLSNMIVKSCKCS

SEQ ID NO: 52 - protein, 207 aa, Homo sapiens
MAPFEPLASGILLLLWLIAPSRACTCVPPHPQTAFCNSDLVIRAKFVGTPEVNQTTLYQRYEIKMTKMYKGFQALGDAADIRFVYTPAMESVCGYFHRSHNRSEEFLIAGKLQDGLLHITTCSFVAPWNSLSLAQRRGFTKTYTVGCEECTVFPCLSIPCKLQSGTHCLWTDQLLQGSEKGFQSRHLACLPREPGLCTWQSLRSQIA

SEQ ID NO: 53 - protein, 207 aa, Homo sapiens; identical to SEQ ID NO: 52

SEQ ID NO: 54 - protein, 173 aa, Homo sapiens
MGRGRCVGPSLQLRGQEWRCSPLVPKGGAAAAELGPGGGENMVRRFLVTLRIRRACGPPRVRVFVVHIPRLTGEWAAPGAPAAVALVLMLLRSQRLGQQPLPRRPGHDDGQRPSGGAAAAPRRGAQLRRPRHSHPTRARRCPGGLPGHAGGAAPGRGAAGRARCLGPSARGPG

SEQ ID NO: 55 - protein, 1479 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESRNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 56 - protein, 345 aa, Homo sapiens
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVNGFDPAPPPPGLGSSRPSSAPGMLPLSV

SEQ ID NO: 57 - protein, 923 aa, Homo sapiens
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 58 - protein, 232 aa, Homo sapiens
MNFLLSWVHWSLALLLYLHHAKWSQAAPMAEGGGQNHHEVVKFMDVYQRSYCHPIETLVDIFQEYPDEIEYIFKPSCVPLMRCGGCCNDEGLECVPTEESNITMQIMRIKPHQGQHIGEMSFLQHNKCECRPKKDRARQEKKSVRGKGKGQKRKRKKSRYKSWSVYVGARCCLMPWSLPGPHPCGPCSERRKHLFVQDPQTCKCSCKNTDSRCKARQLELNERTCRCDKPRR

SEQ ID NO: 59 - protein, 1356 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 60 - protein, 771 aa, Homo sapiens [sequence omitted]

SEQ ID NO: 61 - protein, 785 aa, Homo sapiens
MLVAGLLLWASLLTGAWPSFPTQDHLPATPRVRLSFKELKATGTAHFFNFLLNTTDYRILLKDEDHDRMYVGSKDYVLSLDLHDINREPLIIHWAASPQRIEECVLSGKDVNGECGNFVRLIQPWNRTHLYVCGTGAYNPMCTYVNRGRRAQATPWTQTQAVRGRGSRATDGALRPMPTAPRQDYIFYLEPERLESGKGKCPYDPKLDTASALINEELYAGVYIDFMGTDAAIFRTLGKQTAMRTDQYNSRWLNDPSFIHAELIPDSAERNDDKLYFFFRERSAEAPQSPAVYARIGRICLNDDGGHCCLVNKWSTFLKARLVCSVPGEDGIETHFDELQDVFVQQTQDVRNPVIYAVFTSSGSVFRGSAVCVYSMADIRMVFNGPFAHKEGPNYQWMPFSGKMPYPRPGTCPGGTFTPSMKSTKDYPDEVINFMRSHPLMYQAVYPLQRRPLVVRTGAPYRLTTIAVDQVDAADGRYEVLFLGTDRGTVQKVIVLPKDDQELEELMLEEVEVFKDPAPVKTMTISSKRQQLYVASAVGVTHLSLHRCQAYGAACADCCLARDPYCAWDGQACSRYTASSKRRSRRQDVRHGNPIRQCRGFNSNANKNAVESVQYGVAGSAAFLECQPRSPQATVKWLFQRDPGDRRREIRAEDRFLRTEQGLLLRALQLSDRGLYSCTATENNFKHVVTRVQLHVLGRDAVHAALFPPLSMSAPPPPGAGPPTPPYQELAQLLAQPEVGLIHQYCQGYWRHVPPSPREAPGAPRSPEPQDQKKPRNRRHHPPDT

SEQ ID NO: 62 - protein, 207 aa, Homo sapiens
MSPLLRRLLLAALLQLAPAQAPVSQPDAPGHQRKVVSWIDVYTRATCQPREVVVPLTVELMGTVAKQLVPSCVTVQRCGGCCPDDGLECVPTGQHQVRMQILMIRYPSSQLGEMSLEEHSQCECRPKKKDSAVKPDRAATPHHRPQPRSVPGWDSAPGAPSPADITHPTPAPGPSAHAAPSTTSALTPGPAAAAADAAASSVAKGGA

SEQ ID NO: 63 - protein, 206 aa, Homo sapiens
MSGPGTAAVALLPAVLLALLAPWAGRGGAAAPTAPNGTLEAELERRWESLVALSLARLPVAAQPKEAAVQSGAGDYLLGIKRLRRLYCNVGIGFHLQALPDGRIGGAHADTRDSLLELSPVERGVVSIFGVASRFFVAMSSKGKLYGSPFFTDECTFKEILLPNNYNAYESYKYPGMFIALSKNGKTKKGNRVSPTMKVTHFLPRL

SEQ ID NO: 64 - protein, 931 aa, Homo sapiens
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIRFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 65 - protein, 1338 aa, Homo sapiens
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 66 - protein, 221 aa, Homo sapiens
MPVMRLFPCFLQLLAGLALPAVPPQQWALSAGNGSSEVEVVPFQEVWGRSYCRALERLVDVVSEYPSEVEHMFSPSCVSLLRCTGCCGDENLHCVPVETANVTMQLLKIRSGDRPSYVELTFSQHVRCECRHSPGRQSPDMPGDFRADAPSFLPPRRSLPMLFRMEWGCALTGSQSAVWPSSPVPEEIPRMHPGRNGKKQQRKPLREKMKPERCGDAVPRR

SEQ ID NO: 67 - protein, 904 aa, Homo sapiens
MDAGFFRGTSAEQDNRFSNKQKKLLKQLKFAECLEKKVDMSKVNLEVIKPWITKRVTEILGFEDDVVIEFIFNQLEVKNPDSKMMQINLTGFLNGKNAREFMGELWPLLLSAQENIAGIPSAFLELKKEEIKQRQIEQEKLASMKKQDEDKDKRDKEEKESSREKRERSRSPRRRKSRSPSPRRRSSPVRRERKRSHSRSPRHRTKSRSPSPAPEKKEKTPELPEPSVKVKEPSVQEATSTSDILKVPKPEPIPEPKEPSPEKNSKKEKEKEKTRPRSRSRSKSRSRTRSRSPSHTRPRRRHRSRSRSYSPRRRPSPRRRPSPRRRTPPRRMPPPPRHRRSRSPVRRRRRSSASLSGSSSSSSSSRSRSPPKKPPKRTSSPPRKTRRLSPSASPPRRRHRPSPPATPPPKTRHSPTPQQSNRTRKSRVSVSPGRTSGKVTKHKGTEKRESPSPAPKPRKVELSESEEDKGGKMAAADSVQQRRQYRRQNQQSSSDSGSSSSSEDERPKRSHVKNGEVGRRRRHSPSRSASPSPRKRQKETSPRGRRRRSPSPPPTRRRRSPSPAPPPRRRRTPTPPPRRRTPSPPPRRRSPSPRRYSPPIQRRYSPSPPPKRRTASPPPPPKRRASPSPPPKRRVSHSPPPKQRSSPVTKRRSPSLSSKHRKGSSPSRSTREARSPQPNKRHSPSPRPRAPQTSSSPPPVRRGASSSPQRRQSPSPSTRPIRRVSRTPEPKKIKKAASPSPQSVRRVSSSRSVSGSPEPAAKKPPAPPSPVQSQSPSTNWSPAVPVKKAKSPTPSPSPPRNSDQEGGGKKKKKKKDKKHKKDKKHKKHKKHKKEKAVAAAAAAAVTPAAIAAATTTLAQEEPVAAPEPKKETESEAEDNLDDLEKHLREKALRSMRKAQVSPQS

SEQ ID NO: 68 - protein, 333 aa, Homo sapiens
MPLGLGRRKKAPPLVENEEAEPGRGGLGVGEPGPLGGGGSGGPQMGLPPPPPALRPRLVFHTQLAHGSPTGRIEGFTNVKELYGKIAEAFRLPTAEVMFCTLNTHKVDMDKLLGGQIGLEDFIFAHVKGQRKEVEVFKSEDALGLTITDNGAGYAFIKRIKEGSVIDHIHLISVGDMIEAINGQSLLGCRHYEVARLLKELPRGRTFTLKLTEPRKAFDMISQRSAGGRPGSGPQLGTGRGTLRLRSRGPATVEDLPSAFEEKAIEKVDDLLESYMGIRDTELAATMVELGKDKRNPDELAEALDERLGDFAFPDEFVFDVWGAIGDAKVGRY

SEQ ID NO: 69 - protein, 751 aa, Homo sapiens
MAFRTICVLVGVFICSICVKGSSQPQARVYLTFDELRETKTSEYFSLSHHPLDYRILLMDEDQDRIYVGSKDHILSLNINNISQEALSVFWPASTIKVEECKMAGKDPTHGCGNFVRVIQTFNRTHLYVCGSGAFSPVCTYLNRGRRSEDQVFMIDSKCESGKGRCSFNPNVNTVSVMINEELFSGMYIDFMGTDAAIFRSLTKRNAVRTDQHNSKWLSEPMFVDAHVIPDGTDPNDAKVYFFFKEKLTDNNRSTKQIHSMIARICPNDTGGLRSLVNKWTTFLKARLVCSVTDEDGPETHFDELEDVFLLETDNPRTTLVYGIFTTSSSVFKGSAVCVYHLSDIQTVFNGPFAHKEGPNHQLISYQGRIPYPRPGTCPGGAFTPNMRTTKEFPDDVVTFIRNHPLMYNSIYPIHKRPLIVRIGTDYKYTKIAVDRVNAADGRYHVLFLGTDRGTVQKVVVLPTNNSVSGELILEELEVFKNHAPITTMKISSKKQQLYVSSNEGVSQVSLHRCHIYGTACADCCLARDPYCAWDGHSCSRFYPTGKRRSRRQDVRHGNPLTQCRGFNLKAYRNAAEIVQYGVKNNTTFLECAPKSPQASIKWLLQKDKDRRKEVKLNERIIATSQGLLIRSVQGSDQGLYHCIATENSFKQTIAKINFKVLDSEMVAVVTDKWSPWTWASSVRALPFHPKDIMGAFSHSEMQMINQYCKDTRQQHQQGDESQKMRGDYGKLKALINSRKSRNRRNQLPES

SEQ ID NO: 70 - protein, 155 aa, Homo sapiens
MAEGEITTFTALTEKFNLPPGNYKKPKLLYCSNGGHFLRILPDGTVDGTRDRSDQHIQLQLSAESVGEVYIKSTETGQYLAMDTDGLLYGSQTPNEECLFLERLEENHYNTYISKKHAEKNWFVGLKKNGSCKRGPRTHYGQKAILFLPLPVSSD

SEQ ID NO: 71 - protein, 288 aa, Homo sapiens
MVGVGGGDVEDVTPRPGGCQISGRGARGCNGIPGAAAWEAALPRRRPRRHPSVNPRSRAAGSPRTRGRRTEERPSGSRLGDRGRGRALPGGRLGGRGRGRAPERVGGRGRGRGTAAPRAAPAARGSRPGPAGTMAAGSITTLPALPEDGGSGAFPPGHFKDPKRLYCKNGGFFLRIHPDGRVDGVREKSDPHIKLQLQAEERGVVSIKGVCANRYLAMKEDGRLLASKCVTDECFFFERLESNNYNTYRSRKYTSWYVALKRTGQYKLGSKTGPGQKAILFLPMSAKS

SEQ ID NO: 72 - protein, 194 aa, Homo sapiens
MHKWILTWILPTLLYRSCFHIICLVGTISLACNDMTPEQMATNVNCSSPERHTRSYDYMEGGDIRVRRLFCRTQWYLRIDKRGKVKGTQEMKNNYNIMEIRTVAVGIVAIKGVESEFYLAMNKEGKLYAKKECNEDCNFKELILENHYNTYASAKWTHNGGEMFVALNQKGIPVRGKKTKKEQKTAHFLPMAIT

SEQ ID NO: 73 - protein, 822 aa, Homo sapiens [sequence omitted]

SEQ ID NO: 74 - protein, 1052 aa, Homo sapiens
MAAAYLDPNLNHTPNSSTKTHLGTGMERSPGAMERVLKVFHYFESNSEPTTWASIIRHGDATDVRGIIQKIVDSHKVKHVACYGFRLSHLRSEEVHWLHVDMGVSSVREKYELAHPPEEWKYELRIRYLPKGFLNQFTEDKPTLNFFYQQVKSDYMLEIADQVDQEIALKLGCLEIRRSYWEMRGNALEKKSNYEVLEKDVGLKRFFPKSLLDSVKAKTLRKLIQQTFRQFANLNREESILKFFEILSPVYRFDKECFKCALGSSWIISVELAIGPEEGISYLTDKGCNPTHLADFTQVQTIQYSNSEDKDRKGMLQLKIAGAPEPLTVTAPSLTIAENMADLIDGYCRLVNGTSQSFIIRPQKEGERALPSIPKLANSEKQGMRTHAVSVSETDDYAEIIDEEDTYTMPSTRDYEIQRERIELGRCIGEGQFGDVHQGIYMSPENPALAVAIKTCKNCTSDSVREKFLQEALTMRQFDHPHIVKLIGVITENPVWIIMELCTLGELRSFLQVRKYSLDLASLILYAYQLSTALAYLESKRFVHRDIAARNVLVSSNDCVKLGDFGLSRYMEDSTYYKASKGKLPIKWMAPESINFRRFTSASDVWMFGVCMWEILMHGVKPFQGVKNNDVIGRIENGERLPMPPNCPPTLYSLMTKCWAYDPSRRPRFTELKAQLSTILEEEKAQQEERMRMESRRQATVSWDSGGSDEAPPKPSRPGYPSPRSSEGFYPSPQHMVQTNHYQVSGYPGSHGITAMAGSIYPGQASLLDQTDSWNHRPQEIAMWQPNVEDSTVLDLRGIGQVLPTHLMEERLIRQQQEMEEDQRWLEKEERFLKPDVRLSRGSIDREDGSLQGPIGNQHIYQPVGKPDPAAPPKKPPRPGAPGHLGSLASLSSPADSYNEGVKLQPQEISPPPTANLDRSNDKVYENVTGLVKAVIEMSSKIQPAPPEEYVPMVKEVGLALRTLLATVDETIPLLPASTHREIEMAQKLLNSDLGELINKMKLAQQYVMTSLQQEYKKQMLTAAHALAVDAKNLLDVIDQARLKMLGQTRPH

SEQ ID NO: 75 - protein, 749 aa, Homo sapiens
MGRAGAAAVIPGLALLWAVGLGSAAPSPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 76 - protein, 234 aa, Homo sapiens [sequence omitted]

SEQ ID NO: 77 - protein, 440 aa, Homo sapiens
MASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEVDIDVEHGGKRSRLTPVSPESSSTEEKSSSQPSSCCSDPSKPGGNVEGATQSLAEQMRKIALESEGRPEEQMESDNCSGGDDDWTHLSSKEVDPSTGELQSLQMPESEGPSSLDPSQEGPTGLKEAALYPHLPPEADPRLIESLSQMLSMGFSDEGGWLTRLLQTKNYDIGAALDTIQYSKHPPPL

SEQ ID NO: 78 - protein, 399 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPELQLEESCAEAQDGELDGLWTTITIFITLFLLSVCYSATVTFFKVKWIFSSVVDLKQTIIPDYRNMIGQGA

SEQ ID NO: 79 - protein, 107 aa, Homo sapiens
  MISC_FEATURE (1)..(1): Xaa can be any amino acid
XTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 80 - protein, 1257 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 81 - protein, 777 aa, Homo sapiens
MNANKDERLKARSQDFHLFPALMMLSMTMLFLPVTGTLKQNIPRLKLTYKDLLLSNSCIPFLGSSEGLDFQTLLLDEERGRLLLGAKDHIFLLSLVDLNKNFKKIYWPAAKERVELCKLAGKDANTECANFIRVLQPYNKTHIYVCGTGAFHPICGYIDLGVYKEDIIFKLDTHNLESGRLKCPFDPQQPFASVMTDEYLYSGTASDFLGKDTAFTRSLGPTHDHHYIRTDISEHYWLNGAKFIGTFFIPDTYNPDDDKIYFFFRESSQEGSTSDKTILSRVGRVCKNDVGGQRSLINKWTTFLKARLICSIPGSDGADTYFDELQDIYLLPTRDERNPVVYGVFTTTSSIFKGSAVCVYSMADIRAVFNGPYAHKESADHRWVQYDGRIPYPRPGTCPSKTYDPLIKSTRDFPDDVISFIKRHSVMYKSVYPVAGGPTFKRINVDYRLTQIVVDHVIAEDGQYDVMFLGTDIGTVLKVVSISKEKWNMEEVVLEELQIFKHSSIILNMELSLKQQQLYIGSRDGLVQLSLHRCDTYGKACADCCLARDPYCAWDGNACSRYAPTSKRRARRQDVKYGDPITQCWDIEDSISHETADEKVIFGIEFNSTFLECIPKSQQATIKWYIQRSGDEHREELKPDERIIKTEYGLLIRSLQKKDSGMYYCKAQEHTFIHTIVKLTLNVIENEQMENTQRAEHEEGKVKDLLAESRLRYKDYIQILSSPNFSLDQYCEQMWHREKRRQRNKGGPKWKHMQEMKKKRNRRHHRDLDELPRAVAT

SEQ ID NO: 82 - protein, 782 aa, Homo sapiens
MAPSAWAICWLLGGLLLHGGSSGPSPGPSVPRLRLSYRDLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRGRCPHEPSRPFASTFIDGELYTGLTADFLGREAMIFRSGGPRPALRSDSDQSLLHDPRFVMAARIPENSDQDNDKVYFFFSETVPSPDGGSNHVTVSRVGRVCVNDAGGQRVLVNKWSTFLKARLVCSVPGPGGAETHFDQLEDVFLLWPKAGKSLEVYALFSTVSAVFQGFAVCVYHMADIWEVFNGPFAHRDGPQHQWGPYGGKVPFPRPGVCPSKMTAQPGRPFGSTKDYPDEVLQFARAHPLMFWPVRPRHGRPVLVKTHLAQQLHQIVVDRVEAEDGTYDVIFLGTDSGSVLKVIALQAGGSAEPEEVVLEELQVFKVPTPITEMEISVKRQMLYVGSRLGVAQLRLHQCETYGTACAECCLARDPYCAWDGASCTHYRPSLGKRRFRRQDIRHGNPALQCLGQSQEEEAVGLVAATMVYGTEHNSTFLECLPKSPQAAVRWLLQRPGDEGPDQVKTDERVLHTERGLLFRRLSRFDAGTYTCTTLEHGFSQTVVRLALVVIVASQLDNLFPPEPKPEEPPARGGLASTPPKAWYKDILQLIGFANLPRVDEYCERVWCRGTTECSGCFRSRSRGKQARGKSWAGLELGKKMKSRVHAEHNRTPREVEAT

SEQ ID NO: 83 - protein, 1873 aa, Homo sapiens
MWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 84 - protein, 1894 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 85 - protein, 775 aa, Homo sapiens
MASAGHIITLLLWGYLLELWTGGHTADTTHPRLRLSHKELLNLNRTSIFHSPFGFLDLHTMLLDEYQERLFVGGRDLVYSLSLERISDGYKEIHWPSTALKMEECIMKGKDAGECANYVRVLHHYNRTHLLTCGTGAFDPVCAFIRVGYHLEDPLFHLESPRSERGRGRCPFDPSSSFISTLIGSELFAGLYSDYWSRDAAIFRSMGRLAHIRTEHDDERLLKEPKFVGSYMIPDNEDRDDNKVYFFFTEKALEAENNAHAIYTRVGRLCVNDVGGQRILVNKWSTFLKARLVCSVPGMNGIDTYFDELEDVFLLPTRDHKNPVIFGLFNTTSNIFRGHAICVYHMSSIRAAFNGPYAHKEGPEYHWSVYEGKVPYPRPGSCASKVNGGRYGTTKDYPDDAIRFARSHPLMYQAIKPAHKKPILVKTDGKYNLKQIAVDRVEAEDGQYDVLFIGTDNGIVLKVITIYNQEMESMEEVILEELQIFKDPVPIISMEISSKRQQLYIGSASAVAQVRFHHCDMYGSACADCCLARDPYCAWDGISCSRYYPTGTHAKRRFRRQDVRHGNAAQQCFGQQFVGDALDKTEEHLAYGIENNSTLLECTPRSLQAKVIWFVQKGRETRKEEVKTDDRVVKMDLGLLFLRLHKSDAGTYFCQTVEHSFVHTVRKITLEVVEEEKVEDMFNKDDEEDRHHRMPCPAQSSISQGAKPWYKEFLQLIGYSNFQRVEEYCEKVWCTDRKRKKLKMSPSKWKYANPQEKKLRSKPEHYRLPRHTLDS

SEQ ID NO: 86 - protein, 1049 aa, Homo sapiens
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 87 - protein, 1190 aa, Homo sapiens
MKTRQNKDSMSMRSGRKKEAPGPREELRSRGRASPGGVSTSSSDGKAEKSRQTAKKARVEEASTPKVNKQGRSEEISESESEETNAPKKTKTEQELPRPQSPSDLDSLDGRSLNDDGSSDPRDIDQDNRSTSPSIYSPGSVENDSDSSSGLSQGPARPYHPPPLFPPSPQPPDSTPRQPEASFEPHPSVTPTGYHAPMEPPTSRMFQAPPGAPPPHPQLYPGGTGGVLSGPPMGPKGGGAASSVGGPNGGKQHPPPTTPISVSSSGASGAPPTKPPTTPVGGGNLPSAPPPANFPHVTPNLPPPPALRPLNNASASPPGLGAQPLPGHLPSPHAMGQGMGGLPPGPEKGPTLAPSPHSLPPASSSAPAPPMRFPYSSSSSSSAAASSSSSSSSSSASPFPASQALPSYPHSFPPPTSLSVSNQPPKYTQPSLPSQAVWSQGPPPPPPYGRLLANSNAHPGPFPPSTGAQSTAHPPVSTHHHHHQQQQQQQQQQQQQQQQQQQHHGNSGPPPPGAFPHPLEGGSSHHAHPYAMSPSLGSLRPYPPGPAHLPPPHSQVSYSQAGPNGPPVSSSSNSSSSTSQGSYPCSHPSPSQGPQGAPYPFPPVPTVTTSSATLSTVIATVASSPAGYKTASPPGPPPYGKRAPSPGAYKTATPPGYKPGSPPSFRTGTPPGYRGTSPPAGPGTFKPGSPTVGPGPLPPAGPSGLPSLPPPPAAPASGPPLSATQIKQEPAEEYETPESPVPPARSPSPPPKVVDVPSHASQSARFNKHLDRGFNSCARSDLYFVPLEGSKLAKKRADLVEKVRREAEQRAREEKEREREREREKEREREKERELERSVKLAQEGRAPVECPSLGPVPHRPPFEPGSAVATVPPYLGPDTPALRTLSEYARPHVMSPGNRNHPFYVPLGAVDPGLLGYNVPALYSSDPAAREREREARERDLRDRLKPGFEVKPSELEPLHGVPGPGLDPFPRHGGLALQPGPPGLHPFPFHPSLGPLERERLALAAGPALRPDMSYAERLAAERQHAERVAALGNDPLARLQMLNVTPHHHQHSHIHSHLHLHQQDAIHAASASVHPLIDPLASGSHLTRIPYPAGTLPNPLLPHPLHENEVLRHQLFAAPYRDLPASLSAPMSAAHQLQAMHAQSAELQRLALEQQQWLHAHHPLHSVPLPAQEDYYSHLKKESDKPL

SEQ ID NO: 88 - protein, 330 aa, Homo sapiens
MPRSFLVKSKKAHTYHQPRVQEDEPLWPPALTPVPRDQAPSNSPVLSTLFPNQCLDWTNLKREPELEQDQNLARMAPAPEGPIVLSRPQDGDSPLSDSPPFYKPSFSWDTLATTYGHSYRQAPSTMQSAFLEHSVSLYGSPLVPSTEPALDFSLRYSPGMDAYHCVKCNKVFSTPHGLEVHVRRSHSGTRPFACDICGKTFGHAVSLEQHTHVHSQERSFECRMCGKAFKRSSTLSTHLLIHSDTRPYPCQFCGKRFHQKSDMKKHTYIHTGEKPHKCQVCGKAFSQSSNLITHSRKHTGFKPFSCELCTKGFQRKVDLRRHRESQHNLK

SEQ ID NO: 89 - protein, 748 aa, Homo sapiens
MGRAGAAAVIPGLALLWAVGLGSAAPPPRLRLSFQELQAWHGLQTFSLERTCCYQALLVDEERGRLFVGAENHVASLNLDNISKRAKKLAWPAPVEWREECNWAGKDIGTECMNFVKLLHAYNRTHLLACGTGAFHPTCAFVEVGHRAEEPVLRLDPGRIEDGKGKSPYDPRHRAASVLVGEELYSGVAADLMGRDFTIFRSLGQRPSLRTEPHDSRWLNEPKFVKVFWIPESENPDDDKIYFFFRETAVEAAPALGRLSVSRVGQICRNDVGGQRSLVNKWTTFLKARLVCSVPGVEGDTHFDQLQDVFLLSSRDHRTPLLYAVFSTSSSIFQGSAVCVYSMNDVRRAFLGPFAHKEGPMHQWVSYQGRVPYPRPGMCPSKTFGTFSSTKDFPDDVIQFARNHPLMYNSVLPTGGRPLFLQVGANYTFTQIAADRVAAADGHYDVLFIGTDVGTVLKVISVPKGSRPSAEGLLLEELHVFEDSAAVTSMQISSKRHQLYVASRSAVAQIALHRCAAHGRVCTECCLARDPYCAWDGVACTRFQPSAKRRFRRQDVRNGDPSTLCSGDSSRPALLEHKVFGVEGSSAFLECEPRSLQARVEWTFQRAGVTAHTQVLAEERTERTARGLLLRRLRRRDSGVYLCAAVEQGFTQPLRRLSLHVLSATQAERLARAEEAAPAAPPGPKLWYRDFLQLVEPGGGGSANSLRMCRPQPALQSLPLESRRKGRNRRTHAPEPRAERGPRSATHW

SEQ ID NO: 90 - protein, 739 aa, Homo sapiens
MPGKMVVILGASNILWIMFAASQAFKIETTPESRYLAQIGDSVSLTCSTTGCESPFFSWRTQIDSPLNGKVTNEGTTSTLTMNPVSFGNEHSYLCTATCESRKLEKGIQVEIYSFPKDPEIHLSGPLEAGKPITVKCSVADVYPFDRLEIDLLKGDHLMKSQEFLEDADRKSLETKSLEVTFTPVIEDIGKVLVCRAKLHIDEMDSVPTVRQAVKELQVYISPKNTVISVNPSTKLQEGGSVTMTCSSEGLPAPEIFWSKKLDNGNLQHLSGNATLTLIAMRMEDSGIYVCEGVNLIGKNRKEVELIVQEKPFTVEISPGPRIAAQIGDSVMLTCSVMGCESPSFSWRTQIDSPLSGKVRSEGTNSTLTLSPVSFENEHSYLCTVTCGHKKLEKGIQVELYSFPRDPEIEMSGGLVNGSSVTVSCKVPSVYPLDRLEIELLKGETILENIEFLEDTDMKSLENKSLEMTFIPTIEDTGKALVCQAKLHIDDMEFEPKQRQSTQTLYVNVAPRDTTVLVSPSSILEEGSSVNMTCLSQGFPAPKILWSRQLPNGELQPLSENATLTLISTKMEDSGVYLCEGINQAGRSRKEVELIIQVTPKDIKLTAFPSESVKEGDTVIISCTCGNVPETWIILKKKAETGDTVLKSIDGAYTIRKAQLKDAGVYECESKNKVGSQLRSLTLDVQGRENNKDYFSPELLVLYFASSLIIPAIGMIIYFARKANMKGSYSLVEAQKSKV

SEQ ID NO: 91 - protein, 798 aa, Homo sapiens
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 92 - protein, 146 aa, Homo sapiens [sequence omitted]

SEQ ID NO: 93 - protein, 586 aa, Homo sapiens
MPKPINVRVTTMDAELEFAIQPNTTGKQLFDQVVKTIGLREVWYFGLHYVDNKGFPTWLKLDKKVSAQEVRKENPLQFKFRAKFYPEDVAEELIQDITQKLFFLQVKEGILSDEIYCPPETAVLLGSYAVQAKFGDYNKEVHKSGYLSSERLIPQRVMDQHKLTRDQWEDRIQVWHAEHRGMLKDNAMLEYLKIAQDLEMYGINYFEIKNKKGTDLWLGVDALGLNIYEKDDKLTPKIGFPWSEIRNISFNDKKFVIKPIDKKAPDFVFYAPRLRINKRILQLCMGNHELYMRRRKPDTIEVQQMKAQAREEKHQKQLERQQLETEKKRRETVEREKEQMMREKEELMLRLQDYEEKTKKAERELSEQIQRALQLEEERKRAQEEAERLEADRMAALRAKEELERQAVDQIKSQEQLAAELAEYTAKIALLEEARRRKEDEVEEWQHRAKEAQDDLVKTKEELHLVMTAPPPPPPPVYEPVSYHVQESLQDEGAEPTGYSAELSSEGIRDDRNEEKRITEAEKNERVQRQLLTLSSELSQARDENKRTHNDIIHNENMRQGRDKYKTLRQIRQGNTKQRIDEFEAL

SEQ ID NO: 94 - protein, 577 aa, Homo sapiens
MPKTISVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSIKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERAMLENEKKKREMAEKEKEKIEREKEELMERLKQIEEQTKKAQQELEEQTRRALELEQERKRAQSEAEKLAKERQEAEEAKEALLQASRDQKKTQEQLALEMAELTARISQLEMARQKKESEAVEWQQKAQMVQEDLEKTRAELKTAMSTPHVAEPAENEQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 95 - protein, 94 aa, Homo sapiens
MAPLKMLALVTLLLGASLQHIHAARGTNVGRECCLEYFKGAIPLRKLKTWYQTSEDCSRDAIVFVTVQGRAICSDPNNKRVKNAVKYLQSLERS

SEQ ID NO: 96 - protein, 255 aa, Homo sapiens
MQPLLLLLAFLLPTGAEAGEIIGGRESRPHSRPYMAYLQIQSPAGQSRCGGFLVREDFVLTAAHCWGSNINVTLGAHNIQRRENTQQHITARRAIRHPQYNQRTIQNDIMLLQLSRRVRRNRNVNPVALPRAQEGLRPGTLCTVAGWGRVSMRRGTDTLREVQLRVQRDRQCLRIFGSYDPRRQICVGDRRERKAAFKGDSGGPLLCNNVAHGIVSYGKSSGVPPEVFTRVSSFLPWIRTTMRSFKLLDQMETPL

SEQ ID NO: 97 - protein, 267 aa, Homo sapiens
MTLGRRLACLFLACVLPALLLGGTALASEIVGGRRARPHAWPFMVSLQLRGGHFCGATLIAPNFVMSAAHCVANVNVRAVRVVLGAHNLSRREPTRQVFAVQRIFENGYDPVNLLNDIVILQLNGSATINANVQVAQLPAQGRRLGNGVQCLAMGWGLLGRNRGIASVLQELNVTVVTSLCRRSNVCTLVRGRQAGVCFGDSGSPLVCNGLIHGIASFVRGGCASGLYPDAFAPVAQFVNWIDSIIQRSEDNPCPHPRDPDPASRTH

SEQ ID NO: 98 - protein, 1161 aa, Homo sapiens
MTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKLGFFKRHYKEMLEDKPEDTATFSGDDFSCVAPNVPLS

SEQ ID NO: 99 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 100 - protein, 93 aa, Homo sapiens
MDRLQTALLVVLVLLAVALQATEAGPYGANMEDSVCCRDYVRYRLPLRVVKHFYWTSDSCPRPGVVLLTFRDKEICADPRVPWVKMILNKLSQ

SEQ ID NO: 101 - protein, 325 aa, Homo sapiens
MPITRMRMRPWLEMQINSNQIPGLIWINKEEMIFQIPWKHAAKHGWDINKDACLFRSWAIHTGRYKAGEKEPDPKTWKANFRCAMNSLPDIEEVKDQSRNKGSSAVRVYRMLPPLTKNQRKERKSKSSRDAKSKAKRKSCGDSSPDTFSDGLSSSTLPDDHSSYTVPGYMQDLEVEQALTPALSPCAVSSTLPDWHIPVEVVPDSTSDLYNFQVSPMPSTSEATTDEDEEGKLPEDIMKLLEQSEWQPTNVDGKGYLLNEPGVQPTSVYGDFSCKEEPEIDSPGGDIGLSLQRVFTDLKNMDATWLDSLLTPVRLPSIQAIPCAP

SEQ ID NO: 102 - protein, 968 aa, Homo sapiens
MAEDDPYLGRPEQMFHLDPSLTHTIFNPEVFQPQMALPTDGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 103 - protein, 250 aa, Homo sapiens [sequence omitted]

SEQ ID NO: 104 - protein, 579 aa, Homo sapiens
MLRSGPASGPSVPTGRAMPSRRVARPPAAPELGALGSPDLSSLSLAVSRSTDELEIIDEYIKENGFGLDGGQPGPGEGLPRLVSRGAASLSTVTLGPVAPPATPPPWGCPLGRLVSPAPGPGPQPHLVITEQPKQRGMRFRYECEGRSAGSILGESSTEASKTLPAIELRDCGGLREVEVTACLVWKDWPHRVHPHSLVGKDCTDGICRVRLRPHVSPRHSFNNLGIQCVRKKEIEAAIERKIQLGIDPYNAGSLKNHQEVDMNVVRICFQASYRDQQGQMRRMDPVLSEPVYDKKSTNTSELRICRINKESGPCTGGEELYLLCDKVQKEDISVVFSRASWEGRADFSQADVHRQIAIVFKTPPYEDLEIVEPVTVNVFLQRLTDGVCSEPLPFTYLPRDHDSYGVDKKRKRGMPDVLGELNSSDPHGIESKRRKKKPAILDHFLPNHGSGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 105 - protein, 583 aa, Homo sapiens
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSMMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLKQIEEQTIKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVIPPTENEHDEHDENNAEASAELSNEGVMNHRSEEERVTETQKNERVKKQLQALSSELAQARDETKKTQNDVLHAENVKAGRDKYKTLRQIRQGNTKQRIDEFEAM

SEQ ID NO: 106 - protein, 551 aa, Homo sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 107 - protein, 195 aa, Homo sapiens
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAVAAGGPPGGPQVNPIPVTDEVV

SEQ ID NO: 108 - protein, 570 aa, Homo sapiens
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 109 - protein, 1032 aa, Homo sapiens [sequence omitted]

SEQ ID NO: 110 - protein, 1035 aa, Homo sapiens
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 111 - protein, 526 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 112 - protein, 564 aa, Homo sapiens
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 113 - protein, 150 aa, Homo sapiens
  MISC_FEATURE (1)..(1): Xaa can be any amino acid
XVFPGNDSTASQDVANRFARKGALRQKNVHEVKDHKFIARFFKQPTFCSHCTDFIWGFGKQGFQCQVCCFVVHKRCHEFVTFSCPGADKGPDTDLFSPVLLVCLYLLRSYSLSEGPQEQAQVQNPHLRKPHLLRSLWVTALWTYPSRDEM

SEQ ID NO: 114 - protein, 683 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLRTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 115 - protein, 536 aa, Homo sapiens
MGSNKSKPKDASQRRRSLEPAENVHGAGGGAFPASQTPSKPASADGHRGPSAAFAPAAAEPKLFGGFNSSDTVTSPQRAGPLAGGVTTFVALYDYESRTETDLSFKKGERLQIVNNTEGDWWLAHSLSTGQTGYIPSNYVAPSDSIQAEEWYFGKITRRESERLLLNAENPRGTFLVRESETTKGAYCLSVSDFDNAKGLNVKHYKIRKLDSGGFYITSRTQFNSLQQLVAYYSKHADGLCHRLTTVCPTSKPQTQGLAKDAWEIPRESLRLEVKLGQGCFGEVWMGTWNGTTRVAIKTLKPGTMSPEAFLQEAQVMKKLRHEKLVQLYAVVSEEPIYIVTEYMSKGSLLDFLKGETGKYLRLPQLVDMAAQIASGMAYVERMNYVHRDLRAANILVGENLVCKVADFGLARLIEDNEYTARQGAKFPIKWTAPEAALYGRFTIKSDVWSFGILLTELTTKGRVPYPGMVNREVLDQVERGYRMPCPPECPESLHDLMCQCWRKEPEERPTFEYLQAFLEDYFTSTEPQYQPGENL

SEQ ID NO: 116 - protein, 568 aa, Homo sapiens
MMGCWILNEGLSTILVLSWLGINFYLFIDTFYWYEEEESFHYTRVILGSTLAWARASALCLNFNCMLILIPVSRNLISFIRGTSICCRGPWRRQLDKNLRFHKLVAYGIAVNATIHIVAHFFNLERYHWSQSEEAQGLLAALSKLGNTPNESYLNPVRTFPTNTTTELLRTIAGVTGLVISLALVLIMTSSTEFIRQASYELFWYTHHVFIVFFLSLAIHGTGRIVRGQTQDSLSLHNITFCRDRYAEWQTVAQCPVPQFSGKEPSAWKWILGPVVLYACERIIRFWRFQQEVVITKVVSHPSGVLELHMKKRGFKMAPGQYILVQCPAISSLEWHPFTLTSAPQEDFFSVHIRAAGDWTAALLEAFGAEGQALQEPWSLPRLAVDGPFGTALTDVFHYPVCVCVAAGIGVTPFAALLKSIWYKCSEAQTPLKLSKVYFYWICRDARAFEWFADLLLSLETRMSEQGKTHFLSYHIFLTGWDENQALHIALHWDENTDVITGLKQKTFYGRPNWNNEFKQIAYNHPSSSIGVFFCGPKALSRTLQKMCHLYSSADPRGVHFYYNKESF

SEQ ID NO: 117 - protein, 676 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 118 - protein, 737 aa, Homo sapiens
MVVFNGLLKIKICEAVSLKPTAWSLRHAVGPRPQTFLLDPYIALNVDDSRIGQTATKQKTNSPAWHDEFVTDVCNGRKIELAVFHDAPIGYDDFVANCTIQFEELLQNGSRHFEDWIDLEPEGRVYVIIDLSGSSGEAPKDNEERVFRERMRPRKRQGAVRRRVHQVNGHKFMATYLRQPTYCSHCRDFIWGVIGKQGYQCQVCTCVVHKRCHELIITKCAGLKKQETPDQVGSQRFSVNMPHKFGIHNYKVPTFCDHCGSLLWGLLRQGLQCKVCKMNVHRRCETNVAPNCGVDARGIAKVLADLGVTPDKITNSGQRRKKLIAGAESPQPASGSSPSEEDRSKSAPTSPCDQEIKELENNIRKALSFDNRGEEHRAASSPDGQLMSPGENGEVRQGQAKRLGLDEFNFIKVLGKGSFGKVMLAELKGKDEVYAVKVLKKDVILQDDDVDCTMTEKRILALARKHPYLTQLYCCFQTKDRLFFVMEYVNGGDLMFQIQRSRKFDEPRSRFYAAEVTSALMFLHQHGVIYRDLKLDNILLDAEGHCKLADFGMCKEGILNGVTTTTFCGTPDYIAPEILQELEYGPSVDWWALGVLMYEMMAGQPPFEADNEDDLFESILHDDVLYPVWLSKEAVSILKAFMTKNPHKRLGCVASQNGEDAIKQHPFFKEIDWVLLEQKKIKPPFKPRIKTKRDVNNFDQDFTREEPVLTLVDEAIVKQINQEEFKGFSYFGEDLMP

SEQ ID NO: 119 - protein, 697 aa, Homo sapiens
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 120 - protein, 706 aa, Homo sapiens
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 121 - protein, 1068 aa, Homo sapiens
MPPRPSSGELWGIHLMPPRILVECLLPNGMIVTLECLREATLITIKHELFKEARKYPLHQLLQDESSYIFVSVTQEAEREEFFDETRRLCDLRLFQPFLKVIEPVGNREEKILNREIGFAIGMPVCEFDMVKDPEVQDFRRNILNVCKEAVDLRDLNSPHSRAMYVYPPNVESSPELPKHIYNKLDKGQIIVVIWVIVSPNNDKQKYTLKINHDCVPEQVIAEAIRKKTRSMLLSSEQLKLCVLEYQGKYILKVCGCDEYFLEKYPLSQYKYIRSCIMLGRMPNLMLMAKESLYSQLPMDCFTMPSYSRRISTATPYMNGETSTKSLWVINSALRIKILCATYVNVNIRDIDKIYVRTGIYHGGEPLCDNVNTQRVPCSNPRWNEWLNYDIYIPDLPRAARLCLSICSVKGRKGAKEEHCPLAWGNINLFDYTDTLVSGKMALNLWPVPHGLEDLLNPIGVTGSNPNKETPCLELEFDWFSSVVKFPDMSVIEEHANWSVSREAGFSYSHAGLSNRLARDNELRENDKEQLKAISTRDPLSEITEQEKDFLWSHRHYCVTIPEILPKLLLSVKWNSRDEVAQMYCLVKDWPPIKPEQAMELLDCNYPDPMVRGFAVRCLEKYLTDDKLSQYLIQLVQVLKYEQYLDNLLVRFLLKKALTNQRIGHFFFWHLKSEMHNKTVSQRFGLLLESYCRACGMYLKHLNRQVEAMEKLINLTDILKQEKKDETQKVQMKFLVEQMRRPDFMDALQGFLSPLNPAHQLGNLRLEECRIMSSAKRPLWLNWENPDIMSELLFQNNEIIFKNGDDLRQDMLTLQIIRIMENIWQNQGLDLRMLPYGCLSIGDCVGLIEVVRNSHTIMQIQCKGGLKGALQFNSHTLHQWLKDKNKGEIYDAAIDLFTRSCAGYCVATFILGIGDRHNSNIMVKDDGQLFHIDFGHFLDHKKKKFGYKRERVPFVLTQDFLIVISKGAQECTKTREFERFQEMCYKAYLAIRQHANLFINLFSMMLGSGMPELQSFDDIAYIRKTLALDKTEQEALEYFMKQMNDAHHGGWTTKMDWIFHTIKQHALN

SEQ ID NO: 122 - protein, 1070 aa, Homo sapiens
MCFSFIMPPAMADILDIWAVDSQIASDGSIPVDFLLPTGIYIQLEVPREATISYIKQMLWKQVHNYPMFNLLMDIDSYMFACVNQTAVYEELEDETRRLCDVRPFLPVLKLVTRSCDPGEKLDSKIGVLIGKGLHEFDSLKDPEVNEFRRKMRKFSEEKILSLVGLSWMDWLKQTYPPEHEPSIPENLEDKLYGGKLIVAVHFENCQDVFSFQVSPNMNPIKVNELAIQKRLTIHGKEDEVSPYDYVLQVSGRVEYVFGDHPLIQFQYIRNCVMNRALPHFILVECCKIKKMYEQEMIAIEAAINRNSSNLPLPLPPKKTRIISHVWENNNPFQIVLVKGNKLNTEETVKVHVRAGLFHGTELLCKTIVSSEVSGKNDHIWNEPLEFDINICDLPRMARLCFAVYAVLDKVKTKKSTKTINPSKYQTIRKAGKVHYPVAWVNTMVFDFKGQLRTGDIILHSWSSFPDELEEMLNPMGTVQTNPYTENATALHVKFPENKKQPYYYPPFDKIIEKAAEIASSDSANVSSRGGKKFLPVLKEILDRDPLSQLCENEMDLIWTLRQDCREIFPQSLPKLLLSIKWNKLEDVAQLQALLQIWPKLPPREALELLDFNYPDQYVREYAVGCLRQMSDEELSQYLLQLVQVLKYEPFLDCALSRFLLERALGNRRIGQFLFWHLRSEVHIPAVSVQFGVILEAYCRGSVGHMKVLSKQVEALNKLKTLNSLIKLNAVKLNRAKGKEAMHTCLKQSAYREALSDLQSPLNPCVILSELYVEKCKYMDSKMKPLWLVYNNKVFGEDSVGVIFKNGDDLRQDMLTLQMLRLMDLLWKEAGLDLRMLPYGCLATGDRSGLIEVVSTSETIADIQLNSSNVAAAAAFNKDALLNWLKEYNSGDDLDRAIEEFTLSCAGYCVASYVLGIGDRHSDNIMVKKTGQLFHIDFGHILGNFKSKFGIKRERVPFILTYDFIHVIQQGKTGNTEKFGRFRQCCEDAYLILRRHGNLFITLFALMLTAGLPELTSVKDIQYLKDSLALGKSEEEALKQFKQKFDEALRESWTTKVNWMAHTVRKDYRS

SEQ ID NO: 123 - protein, 1044 aa, Homo sapiens
MPPGVDCPMEFWTKEENQSVVVDFLLPTGVYLNFPVSRNANLSTIKQLLWHRAQYEPLFHMLSGPEAYVFTCINQTAEQQELEDEQRRLCDVQPFLPVLRLVAREGDRVKKLINSQISLLIGKGLHEFDSLCDPEVNDFRAKMCQFCEEAAARRQQLGWEAWLQYSFPLQLEPSAQTWGPGTLRLPNRALLVNVKFEGSEESFTFQVSTKDVPLALMACALRKKATVFRQPLVEQPEDYTLQVNGRHEYLYGSYPLCQFQYICSCLHSGLTPHLTMVHSSSILAMRDEQSNPAPQVQKPRAKPPPIPAKKPSSVSLWSLEQPFRIELIQGSKVNADERMKLVVQAGLFHGNEMLCKTVSSSEVSVCSEPVWKQRLEFDINICDLPRMARLCFALYAVIEKAKKARSTKKKSKKADCPIAWANLMLFDYKDQLKTGERCLYMWPSVPDEKGELLNPTGTVRSNPNTDSAAALLICLPEVAPHPVYYPALEKILELGRHSECVHVTEEEQLQLREILERRGSGELYEHEKDLVWKLRHEVQEHFPEALARLLLVTKWNKHEDVAQMLYLLCSWPELPVLSALELLDFSFPDCHVGSFAIKSLRKLTDDELFQYLLQLVQVLKYESYLDCELTKFLLDRALANRKIGHFLFWHLRSEMHVPSVALRFGLILEAYCRGSTHHMKVLMKQGEALSKLKALNDFVKLSSQKTPKPQTKELMHLCMRQEAYLEALSHLQSPLDPSTLLAEVCVEQCTFMDSKMKPLWIMYSNEEAGSGGSVGIIFKNGDDLRQDMLTLQMIQLMDVLWKQEGLDLRMTPYGCLPTGDRTGLIEVVLRSDTIANIQLNKSNMAATAAFNKDALLNWLKSKNPGEALDRAIEEFTLSCAGYCVATYVLGIGDRHSDNIMIRESGQLFHIDFGHFLGNFKTKFGINRERVPFILTYDFVHVIQQGKTNNSEKFERFRGYCERAYTILRRHGLLFLHLFALMRAAGLPELSCSKDIQYLKDSLALGKTEEEALKHFRVKFNEALRESWKTKVNWLAHNVSKDNRQ

SEQ ID NO: 124 - protein, 1102 aa, Homo sapiens
MELENYKQPVVLREDNCRRRRRMKPRSAAASLSSMELIPIEFVLPTSQRKCKSPETALLHVAGHGNVEQMKAQVWLRALETSVAADFYHRLGPHHFLLLYQKKGQWYEIYDKYQVVQTLDCLRYWKATHRSPGQIHLVQRHPPSEESQAFQRQLTALIGYDVTDVSNVHDDELEFTRRGLVTPRMAEVASRDPKLYAMHPWVTSKPLPEYLWKKIANNCIFIVIHRSTTSQTIKVSPDDTPGAILQSFFTKMAKKKSLMDIPESQSEQDFVLRVCGRDEYLVGETPIKNFQWVRHCLKNGEEIHVVLDTPPDPALDEVRKEEWPLVDDCTGVTGYHEQLTIHGKDHESVFTVSLWDCDRKFRVKIRGIDIPVLPRNTDLTVFVEANIQHGQQVLCQRRTSPKPFTEEVLWNVWLEFSIKIKDLPKGALLNLQIYCGKAPALSSKASAESPSSESKGKVQLLYYVNLLLIDHRFLLRRGEYVLHMWQISGKGEDQGSFNADKLTSATNPDKENSMSISILLDNYCHPIALPKHQPTPDPEGDRVRAEMPNQLRKQLEAIIATDPLNPLTAEDKELLWHFRYESLKHPKAYPKLFSSVKWGQQEIVAKTYQLLARREVWDQSALDVGLTMQLLDCNFSDENVRAIAVQKLESLEDDDVLHYLLQLVQAVKFEPYHDSALARFLLKRGLRNKRIGHFLFWFLRSEIAQSRHYQQRFAVILEAYLRGCGTAMLHDFTQQVQVIEMLQKVTLDIKSLSAEKYDVSSQVISQLKQKLENLQNSQLPESFRVPYDPGLKAGALAIEKCKVMASKKKPLWLEFKCADPTALSNETIGIIFKHGDDLRQDMLILQILRIMESIWETESLDLCLLPYGCISTGDKIGMIEIVKDATTIAKIQQSTVGNTGAFKDEVLNHWLKEKSPTEEKFQAAVERFVYSCAGYCVATFVLGIGDRHNDNIMITETGNLFHIDFGHILGNYKSFLGINKERVPFVLTPDFLFVMGTSGKKTSPHFQKFQDICVKAYLALRHHTNLLIILFSMMLMTGMPQLTSKEDIEYIRDALTVGKNEEDAKKYFLDQIEVCRDKGWTVQFNWFLHLVLGIKQGEKHSA

SEQ ID NO: 125 - protein, 724 aa, Homo sapiens
MSAEGYQYRALYDYKKEREEDIDLHLGDILTVNKGSLVALGFSDGQEARPEEIGWLNGYNETTGERGDFPGTYVEYIGRKKISPPTPKPRPPRPLPVAPGSSKTEADVEQQALTLPDLAEQFAPPDIAPPLLIKLVEAIEKKGLECSTLYRTQSSSNLAELRQLLDCDTPSVDLEMIDVHVLADAFKRYLLDLPNPVIPAAVYSEMISLAPEVQSSEEYIQLLKKLIRSPSIPHQYWLTLQYLLKHFFKLSQTSSKNLLNARVLSEIFSPMLFRFSAASSDNTENLIKVIEILISTEWNERQPAPALPPKPPKPTTVANNGMNNNMSLQDAEWYWGDISREEVNEKLRDTADGTFLVRDASTKMHGDYTLTLRKGGNNKLIKIFHRDGKYGFSDPLTFSSVVELINHYRNESLAQYNPKLDVKLLYPVSKYQQDQVVKEDNIEAVGKKLHEYNTQFQEKSREYDRLYEEYTRTSQEIQMKRTAIEAFNETIKIFEEQCQTQERYSKEYIEKFKREGNEKEIQRIMHNYDKLKSRISEIIDSRRRLEEDLKKQAAEYREIDKRMNSIKPDLIQLRKTRDQYLMWLTQKGVRQKKLNEWLGNENTEDQYSLVEDDEDLPHHDEKTWNVGSSNRNKAENLLRGKRDGTFLVRESSKQGCYACSVVVDGEVKHCVINKTATGYGFAEPYNLYSSLKELVLHYQHTSLVQHNDSLNVTLAYPVYAQQRR

SEQ ID NO: 126 - protein, 728 aa, Homo sapiens
MAGPEGFQYRALYPFRRERPEDLELLPGDVLVVSRAALQALGVAEGGERCPQSVGWMPGLNERTRQRGDFPGTYVEFLGPVALARPGPRPRGPRPLPARPRDGAPEPGLTLPDLPEQFSPPDVAPPLLVKLVEAIERTGLDSESHYRPELPAPRTDWSLSDVDQWDTAALADGIKSFLLALPAPLVTPEASAEARRALREAAGPVGPALEPPTLPLHRALTLRFLLQHLGRVASRAPALGPAVRALGATFGPLLLRAPPPPSSPPPGGAPDGSEPSPDFPALLVEKLLQEHLEEQEVAPPALPPKPPKAKPASTVLANGGSPPSLQDAEWYWGDISREEVNEKLRDTPDGTFLVRDASSKIQGEYTLTLRKGGNNKLIKVFHRDGHYGFSEPLTFCSVVDLINHYRHESLAQYNAKLDTRLLYPVSKYQQDQIVKEDSVEAVGAQLKVYHQQYQDKSREYDQLYEEYTRTSQELQMKRTAIEAFNETIKIFEEQGQTQEKCSKEYLERFRREGNEKEMQRILLNSERLKSRIAEIHESRTKLEQQLRAQASDNREIDKRMNSLKPDLMQLRKIRDQYLVWLTQKGARQKKINEWLGIKNETEDQYALMEDEDDLPHHEERTWYVGKINRTQAEEMLSGKRDGTFLIRESSQRGCYACSVVVDGDTKHCVIYRTATGFGFAEPYNLYGSLKELVLHYQHASLVQHNDALTVTLAHPVRAPGPGPPPAAR

SEQ ID NO: 127 - protein, 461 aa, Homo sapiens
MYNTVWSMDRDDADWREVMMPYSTELIFYIEMDPPALPPKPPKPMTSAVPNGMKDSSVSLQDAEWYWGDISREEVNDKLRDMPDGTFLVRDASTKMQGDYTLTLRKGGNNKLIKIYHRDGKYGFSDPLTFNSVVELINHYHHESLAQYNPKLDVKLMYPVSRYQQDQLVKEDNIDAVGKKLQEYHSQYQEKSKEYDRLYEEYTRTSQEIQMKRTAIEAFNETIKIFEEQCHTQEQHSKEYIERFRREGNEKEIERIMMNYDKLKSRLGEIHDSKMRLEQDLKNQALDNREIDKKMNSIKPDLIQLRKIRDQHLVWLNHKGVRQKRLNVWLGIKNEDADENYFINEEDENLPHYDEKTWFVEDINRVQAEDLLYGKPDGAFLIRESSKKGCYACSVVADGEVKHCVIYSTARGYGFAEPYNLYSSLKELVLHYQQTSLVQHNDSLNVRLAYPVHAQMPSLCR

SEQ ID NO: 128 - protein, 211 aa, Homo sapiens
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVPRPWQSLRTSSRRPQRHRSWHLASGMLQRPGGGSGPSCRRWEKKLASLGC

SEQ ID NO: 129 - protein, 348 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSLRPLPLTSPSHGSLSHSKAPSGSQMSHNAVTSHQRPGWPGQPHSPFPHPTPHFQPDASLLQPVTPLGTSRWRKISAALPY

SEQ ID NO: 130 - protein, 390 aa, Homo sapiens
MGDTFIRHIALLGFEKRFVPSQHYVYMFLVKWQDLSEKVVYRRFTEIYEFHKTLKEMFPIEAGAINPENRIIPHLPAPKWFDGQRAAENHQGTLTEYCSTLMSLPTKISRCPHLLDFFKVRPDDLKLPTDNQTKKPETYLMPKDGKSTATDITGPIILQTYRAIADYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 131 - protein, 1356 aa, Homo sapiens; identical to SEQ ID NO: 59

We claim:

1. A method for detecting cancer or precancerous lesions in a patient, or for determining a risk for cancer development in a patient comprising:
   (a) administering a composition of microbubbles having a plurality of anti-Thy-1 antibodies attached thereto to a patient at risk of having or developing cancer wherein binding complexes form between the binding molecules, the microbubbles having a plurality of anti-Thy-1 antibodies attached thereto and targets of the binding molecules present in neovasculature of the cancer or the precancerous lesions; and
   (b) detecting a presence or absence of the binding complexes using ultrasound molecular imaging; wherein the presence of any number of the binding complexes greater than a control is indicative of the presence of cancer or precancerous lesions in the patient or indicates a risk of cancer development in the patient.

2. The method of claim 1, wherein the presence of the binding complexes in a number greater than a control is indicative of the presence of a precancerous lesion, and thus indicative of a risk of cancer development in the patient.

3. The method of claim 1, wherein the presence of the binding complexes in a number greater than a control is indicative of the presence of cancer in the patient.

4. The method of claim 1, wherein the composition of microbubbles comprises at least $10^7$ microbubbles having a plurality of anti-Thy-1 antibodies.

5. The method of claim 1, wherein the composition of microbubbles further comprises one or more anti-cancer therapeutics.

* * * * *